US006623962B1

United States Patent
Akhtar et al.

(10) Patent No.: US 6,623,962 B1
(45) Date of Patent: *Sep. 23, 2003

(54) ENZYMATIC NUCLEIC ACID TREATMENT OF DISEASES OF CONDITIONS RELATED TO LEVELS OF EPIDERMAL GROWTH FACTOR RECEPTORS

(75) Inventors: Saghir Akhtar, Birmingham (GB); Patricia Fell, Birmingham (GB); James A. McSwiggen, Boulder, CO (US)

(73) Assignees: Sirna Therapeutics, Inc., Boulder, CO (US); Aston University, Birmingham (GB)

(*) Notice: Subject to any disclaimer, the term of this patent is extended or adjusted under 35 U.S.C. 154(b) by 0 days.

This patent is subject to a terminal disclaimer.

(21) Appl. No.: 09/401,063

(22) Filed: Sep. 22, 1999

Related U.S. Application Data

(63) Continuation of application No. 08/985,162, filed on Dec. 4, 1997, now Pat. No. 6,057,156.
(60) Provisional application No. 60/036,476, filed on Jan. 31, 1997.

(51) Int. Cl.[7] .................... C07H 21/04; C12N 15/86; C12N 15/85; C12Q 1/68; C12P 19/34
(52) U.S. Cl. .................... 435/375; 435/6; 435/91.1; 435/91.3; 536/23.1; 536/23.2; 536/24.3; 536/24.31; 536/24.33; 536/24.5
(58) Field of Search .................... 435/6, 91.1, 91.3, 435/375; 536/23.1, 23.2, 24.5, 24.3, 24.31, 24.33

(56) References Cited

U.S. PATENT DOCUMENTS

| 4,987,071 A | 1/1991 | Cech et al. |
| 5,334,711 A | 8/1994 | Sproat et al. |
| 5,525,468 A | 6/1996 | McSwiggen |
| 5,807,718 A * | 9/1998 | Joyce et al. ............... 435/91.5 |

FOREIGN PATENT DOCUMENTS

| CA | 2012312 | 9/1990 |
| EP | 0 360 257 A2 | 3/1990 |
| EP | 0 387 775 A | 9/1990 |
| WO | WO 91/03162 | 3/1991 |
| WO | 91/15580 | 10/1991 |
| WO | WO 92/07065 | 4/1992 |
| WO | WO 93/15187 | 8/1993 |
| WO | WO 93/23057 | 11/1993 |
| WO | WO 93/23569 | 11/1993 |
| WO | WO 94/02595 | 2/1994 |
| WO | WO 94/11499 | 5/1994 |
| WO | 94/16738 | 8/1994 |
| WO | WO 95/04818 | 2/1995 |
| WO | WO 96/22689 | 8/1996 |

OTHER PUBLICATIONS

Ortigao et al. "antisense Effect of Oligonucleotides with Inverted Terminal Internucleotidic Linkages: A Minimal Modification Protecting Against Nucleolytic Degradation", Antisense Research and Development 2:129–146, 1992.*

Usman et al. "Design, Synthesis, and Function of Therapeutic Hammerhead Ribozymes" Nucleic Acids and Molecular Biology, Vol 10, p 243–264, 1996.*

Rossi, "Controlled, Targeted, intracellular expression of ribozymes: progress and problems", TIBTECH Vol 13, p301–306, Aug. 1995.*

(List continued on next page.)

Primary Examiner—Karen Lacourciere
(74) Attorney, Agent, or Firm—McDonnell Boehnen Hulbert & Berghoff

(57) ABSTRACT

Enzymatic nucleic acid molecules which cleave EGFR RNA.

20 Claims, 11 Drawing Sheets

OTHER PUBLICATIONS

Yamazaki et al. "Cleavage of glioma–specific abberant mRNA of epidermal growth factor receptor (EGFR) by ribozyme in vitro", Proceedings of the American Association for Cancer REsearch Annual Meeting, vol. 36, No. 0, pp. 429. (abstract No. 2556), 1995.*

Adams et al., "A Convenient Synthesis Of S–Cyanoethyl–Protected 4–Thiouridine and Its Incorporation Into Oligorobonucleotides," *Tetrahedron Letters* 35(5):765–768 (1994).

Akhtar et al., "Cellular uptake and intracellular fate of antisense oligonucleotides," *Trends in Cell Biology* 2:139–144 (1992).

Akhtar et al., *"Molecular DIY with Hairpins and Hammerheads," Nature Medicine* 1(4):300–302 (1995).

Akhtar et al., "Stability of Antisense DNA Oligodeoxynucleotide Analogs in Cellular Extracts and Sera," *Life Sciences*, 49:793–1801 (1991).

Ali et al., "The Use of DNA Viruses as Vectors for Gene Therapy," *Gene Therapy* 1(6):367–384 (1994).

Altman, "RNA Enzyme–Directed Gene Therapy," *Proc. Natl. Acad. Sci. USA*, 90:10898–10900 (1993).

Amiri et al., "Global Conformation of a Self–Cleaving Hammerhead RNA," *Biochemistry* 33:13172–13177 (1994).

Aurup et al., "Chapter 10: Stabilized RNA Analogs for Antisense and Ribozyme Applications," *Delivery Strategies for Antisense Oligonucleotide Therapeutics*, 161–177 (1995).

Ayers et al., "Polyacrylic acid mediated ocular delivery of ribozymes," *Journal of Controlled Release*, 38:167–175 (1996).

Bacchetti et al., "Telomerers and Telomerase in Human Cancer (Review)," *International Journal of Oncology* 7:423–432 (1995).

Barinaga, "Ribozymes: Killing the Messenger," *Science*, 262:1512–1514 (1993).

Bassi et al., "Ionic interactions and the global conformations of the hammerhead ribozyme," *Nature Structural Biol.*, 2(1):45–55 (1995).

Beigelman et al., "Alternate Approaches to the Synthesis of 2'–O–Me Nucleosides," *Nucleosides and Nucleotides*, 14(3–5):421–425 (1995).

Beigelman et al., "Chemical Modification of Hammerhead Ribozynes," *Journal of Biological Chemistry*, 270(43):25702–25708 (1995).

Beigelman et al., "Synthesis of 1–Deoxy–D–Ribofuranose Phosphoramidite & the Incorporation of Abasic Nucleotides in Stem–Loop II of A Hammerhead Ribozyme," *Biorg. Med. Chem. Lett.* 4(14):1715–1720 (1994).

Beigelman et al., "Synthesis of 2'–modified nucleotides and their incorporation into hammerhead ribozymes," *Nucleic Acids Research*, 23(21):4434–4442 (1995).

Beltinger et al., "Binding, Uptake, and Intracellular Trafficking of Phosphorothioate–modified Oligodeoxynucleotides," *J. Clin. Invest.*, 95:1814–1823 (1995).

Bertrand et al., "Anti–HIV Therapeutic Hammerhead Ribozymes: Targeting Strategies and Optimization of Intracellular Function," *Nucleic Acids and Molecular Biology* 10:301–313 (1996).

Bertrand et al., "Can hammerhead ribozymes be efficient tools to inactivate gene function?" *Nucleic Acids Research* 22(3):293–300 (1994).

Bertrand et al., "Facilitation of hammerhead ribozyme catalysis by the nucleocapsid protein of HIV–1 and the heterogeneous nuclear ribonucleoprotein A1," *EMBO Journal*, 13(12):2904–2912 (1994).

Bigner et al., "Cytogenetics and Molecular Genetics of Malignant Gliomas and Medulloblastoma," *Brain Pathol.*, 1:12–18 (1990).

Black et al., "Brain Tumors," *New England Journal of Medicine* 324(21):1417–1476 & (22):1555–1564 (1991).

Bratty et al., "The Hammerhead RNA Domain, a Model Ribozyme," *Biochimica et Biophysica Acta.* 1216:345–359 (1993).

Brem, et al., "Interstitial chemotherapy with drug polymer implants for the treatment of recurrent gliomas," *Journal of Neurosurgery*, 74:441–446 (1991).

Bruner, "Neuropathology of Malignant Gliomas," *Seminars in Oncology*, 21(2):126–138 (1994).

Cech et al., "Biological Catalysis By RNA," *Annual Review of Biochemistry*, 55:599–629 (1986).

Cech et al., "Hammerhead Nailed Down," *Nature*, 372:39–40 (1994).

Cech et al., "In Vitro Splicing of the Ribosomal RNA Precursor of Tetrahymena: Involvement of a Guanosine Nucleotide in the Excision of the Intervening Sequence," *Cell*, 27:487–496 (1981).

Cech, "Ribozymes and Their Medical Implications," *JAMA* 260(20):3030–3034 (1988).

Chadeneau et al., "Telomerase Activity in Normal and Malignant Murine Tissues," *Oncogene* 11:893–898 (1995).

Chen et al., "Multitarget–Ribozyme Directed to Cleave at up to Nine Highly Conserved HIV–1 env RNA Regions Inhibits HIV–1 Replication–Potential Effectiveness Against Most Presently Sequenced HIV–1 Isolates," *Nucleic Acids Research* 20(17):4581–4589 (1992).

Chen et al., "Effects on Tumor Cells of Ribozymes that Cleave the RNA Transcripts of Human Papillomavirus Type 18," *Cancer Gene Therapy* 3(1):18–23 (1996).

Chowrira et al., "Extensive Phosphorothioate Substitution Yields Highly Active and Nuclease–Resistant Hairpin Ribozymes," *Nucleic Acids Research* 20(11):2835–2840 (1992).

Chowrira et al., "In Vitro and in Vivo Comparison of Hammerhead, Hairpin, and Hepatitis Delta Virus Self–Processing Ribozyme Cassettes," *J. Biol. Chem.* 269(41):25856–25864 (1994).

Christoffersen and Marr, "Ribozymes as Human Therapeutic Agents," *J. Med. Chem.* 38(12):2023–2037 (1995).

Christoffersen et al., "Application of Computational Technologies to Ribozyme Biotechnology Products," *Journal of Molecular Structure (Theochem)* 311:273–284 (1994).

Collins et al., "Reaction Conditions and Kinetics of Self–Cleavage of a Ribozyme Derived From Neurospora VS RNA," *Biochemistry* 32:2795–2799 (1993).

Couture and Stinchomb, "Anti–gene Therapy: the Use of Ribozymes to Inhibit Gene Function," *TIG*, 12(12):510 (1996).

Crooke, "Therapeutic Applications of Oligonucleotides," *Annual Review of Pharmacology and Toxicology*, 32:329–379 (1992).

Denman, "Biocomputing: Using RNAFOLD to Predict the Activity of Small Catalytic RNAs," *BioTechniques*, 15(6):1090–1094 (1993).

Denman, "Facilitator Oligonucleotides Increase Ribozyme RNA binding to full–length RNA Substrates in vitro," *FEBS Letters* 382:116–120 (1996).

Downward, "Close similarity of Epidermal Growth Factor Receptor and v–erb–B Oncogene Protein Sequences," *Nature* 307(5951):521–527 (1984).

Dreyfus, "Restriction Ribozymes?" *Einstein Quarterly Journal of Biology and Medicine* 6(2):92–93 (1988).

Dropulic et al., "Functional Characterization of a U5 Ribozyme: Intracellular Suppression of Human Immunodeficiency Virus Type I Expression," *Journal of Virology* 66(3):1432–1441 (1992).

Dropulic et al., "Meeting Report–Ribozymes: Use as Anti–HIV Therapeutic Molecules," *Antisense Research and Development*, 3:87–94 (1993).

Eckstein, "Nucleoside Phoshorothioates," *Annual Review of Biochemistry* 54:367–402 (1985).

Ekstrand et al., "Genes for Epidermal Growth Factor Receptor, Transforming Growth Factor α, and Epidermal Growth Factor and Their Expression in Human Gliomas in Vivo," *Cancer Research* 51:2164–2172 (1991).

Elkins et al., "Cellular Delivery of Ribozymes," *Delivery Strategies for Antisense Oligonucleotide Therapeutics*, London, CRC Press, 17–37 (1995).

Ellis et al., "Design and Specificity of Hammerhead Ribozymes Against Calretinin mRNA," *Nucleic Acids Research* 21(22):5171–5178 (1993).

Elroy–Stein et al., "Cytoplasmic Expression System Based on Constitutive Synthesis of Bacteriophage T7 RNA Polymerase in Mammalian Cells," *Proc. Natl. Acad. Sci. USA* 87:6743–6747 (1990).

Fedor et al., "Kinetics of Intermolecular Cleavage by Hammerhead Ribozymes," *Biochemistry* 31:12042–12054 (1992).

Fedor et al., "Substrate sequence effects on "hammerhead" RNA catalytic efficiency," *Proc. Natl. Acad. Sci. USA* 87:1668–1672 (1990).

Feldstein et al., "Two Sequences Participating in the Autolytic Processing of Satellite Tobacco Ringspot Virus Complementary RNA," *Gene* 82:53–61 (1989).

Felgner et al., "Enhanced Gene Delivery and Mechanism Studies with a Novel Series of Cationic Lipid Formulations," *Journal of Biological Chemistry* 269(4):2550–2561 (1994).

Fell et al., "Cellular Uptake Properties of a 2'–amino/2'–O–Methyl–Modified Chimeric Hammerhead Ribozyme Targeted to the Epidermal Growth Factor Receptor mRNA," *Antisense Nucleic Acid Drug Development* 7(4):319–326 (1997).

Feng et al., "The RNA Component of Human Telomerase," *Science* 269:1236–1241 (1995).

Fine, et al., "Meta–Analysis of Radiation Therapy with and without Adjuvant Chemotherapy for Malignant Gliomas in Adults," *Cancer*, 71(8):2585–2597, (1993).

Flory et al., "Nuclease–resistant ribozymes decrease stromelysin mRNA levels in rabbit synovium following exogenous delivery to the knee joint," *Proc. Natl. Acad. Sci. USA*, 93:754–758 (1996).

Forster and Altman, "External Guide Sequences for an RNA Enzyme," *Science* 249:783–786 (1990).

Foster et al., "Self–cleavage of Plus and Minus RNAs of a Virusoid and a Structural Model for the Active Sites," *Cell* 49:211–220 (1987).

Fu et al., "Importance of specific purine amino and hydroxyl groups for efficient cleavage by a hammmerhead ribozyme," *Proc. Natl. Acad. Sci. USA*, 89:3985–3989 (1992).

Gait et al., "Synthetic Ribonucleotide Analogues for RNA Structure–Function Studies," *Nucleosides and Nucleotides* 14(3–5):1133–1144 (1995).

Gao et al., "Cytoplasmic Expression of a Reporter Gene by Co–Delivery of T7 RNA Polymerase and T7 Promoter Sequence with Cationic Liposomes," *Nucleic Acids Research* 21(12):2867–2872 (1993).

Gish et al., "Phosphorothioates in Molecular Biology," *Trends in Biochemical Sciences* 14:97–100 (1989).

Goodarzi, et al., "Binding of Oligonucleotides to Cell Membranes at Acidic pH," *Biochem. Biophys. Res. Comm.* 181(3):1343–1351, (1991).

Goodchild et al., "Enhancement of Ribozyme Catalytic Activity by a Contiguous Oligodeoxynucleotide (Facilitator) and By 2'–O–Methylation," *Nucleic Acids Research*, 20(17):4607–4612 (1990).

Griffin, Jr., et al., "Group II Intron Ribozymes that Cleave DNA and RNA Linkages with Similar Efficiency, and Lack Contacts with Substrate 2'–Hydroxyl Groups," *Chemistry & Biology* 2(11):761–770 (1995).

Griffiths et al., "Stereospecificity of Nucleases Towards Phosphorothioate–Substituted RNA: Stereochemistry of Transcription by T7 RNA Polymerase," *Nucleic Acids Research* 15(10):4145–4162 (1987).

Guerrier–Takada et al., "The RNA Moiety of Ribonuclease P Is the Catalytic Subunit of the Enzyme," *Cell* 35:849–857 (1983).

Guo et al., "Efficent Trans–Cleavage of a Stem–Loop RNA Substrate by a Ribozyme Derived from Neurospora VS RNA," *EMBO J.* 14(2):368–376 (1995).

Gutierrez et al, "Gene Therapy for Cancer," *The Lancet* 339:715–719 (1992).

Hampel et al., "'Hairpin' Catalytic RNA Model: Evidence for Helices and Sequence Requirement for Substrate RNA," *Nucleic Acids Research* 18(2):299–304 (1990).

Hampel et al., "RNA Catalytic Properties of the Minimum (–)sTRSV Sequence," *Biochemistry* 28:4929–4933 (1989).

Haseloff et al., "Sequences Required for Self–Catalysed Cleavage of the Satellite RNA of Tobacco Ringspot Virus," *Gene* 82:43–52 (1989).

Haseloff et al., "Simple RNA Enzymes with New and Highly Specific Endoribonuclease Activities," *Nature* 334:585–591 (1988).

Healy, "Telomere Dynamics and Telomerase Activation in Tumor Progression: Prospects for Prognosis and Therapy," *Oncology Research* 7(3/4):121–130 (1995).

Heidenreich et al., "Chemically Modified RNA: Approaches and Applications," *FASEB Journal* 7(1):90–96 (1993).

Heidenreich et al., "High Activity and Stability of Hammerhead Ribozymes Containing 2'–Modified Pyrimidine Nucleosides and Phosphorothioates," *Journal of Biological Chemistry* 269(3):2131–2138 (1994).

Hendry et al., "A Comparison of the in vitro activity of DNA–Armed and all–RNA Hammerhead Ribozymes," *Nucleic Acids Research* 23(19):3928–3936 (1995).

Herschlag et al., "An RNA chaperone activity of non–specific RNA binding proteins in hammerheads ribozymes catalysis," *EMBO Journal* 13(12):2913–2924 (1994).

Hertel et al., "Numbering System for the Hammerhead," *Nucleic Acids Research* 20(12):3252 (1992).

Hertel et al., "A Kinetic and Thermodynamic Framework for the Hammerhead Ribozyme Reaction," *Biochemistry* 33(11):3374–3385 (1994).

Homann et al., "Extension of helix II of an HIV–1–directed hammerhead ribozyme with long antisense flanks does not alter kinetic parameters in vitro but causes loss of the inhibitory potenial in living cells," *Nucleic Acids Research* 22(19):3951–3957 (1994).

Inoue, T., "Time to Change Partners," *Nature* 370:99–100 (1994).

Izant et al., "Constitutive and Conditional Suppression of Exogenous and Endogenous Genes by Anti–Sense RNA," *Science* 229:345–352 (1985).

Jaeger et al., "Improved Predictions of Secondary Structures for RNA," *Proc. Natl. Acad. Sci. USA* 86:7706–7710 (1989).

Jaroszewski et al., (1990) (references the cellular association of oligonucleotides, . . . uptake and efflux processes).

Jarvis et al., "Inhibition of Vascular Smooth Muscle Cell proliferation by Ribozymes that Cleave c–myb mRNA," *RNA* 2:419–428 (1996).

Jeffries et al., "A Catalytic 13–mer Ribozyme," *Nucleic Acids Research* 17(4):1371–1377 (1989).

Juliano et al., "Liposomes as a Drug Delivery System for Antisense Oligonucleotides," *Antisense Research and Development* 2:165–176 (1992).

Kanazawa et al., "Hammerhead Ribozyme–Mediated Inhibition of Telomerase Activity in Extracts of Human Hepatocellular Carcinoma Cells," *Biochemical and Biophysical Research Communication* 225:570–576 (1996).

Kariko et al., "Lipofectin–aided Cell Delivery of Ribozyme Targeted to Human Urokinase Receptor mRNA," *FEBS Letters* 352:41–44 (1994).

Kashani–Sabet et al., "Reversal of the Malignant Phenotype by an Anti–ras Ribozyme," *Antisense Research & Development* 2:3–15 (1992).

Khazaie et al., "EGF Receptor in Neoplasia and Metastasis," *Cancer and Metastasis Reviews*, 12:255–274 (1993).

Kiehntopf et al., "Clinical Applications of Ribozymes," *The Lancet* 345:1027–1031 (1995).

Kiehntopf et al., "Ribozyme–Mediated Cleavage of the MDR–1 Transcript Restores Chemosensitivity in Previously Resistant Cancer Cells," *EMBO Journal* 13(19):4645–4652 (1994).

Kiehntopf et al., "Ribozymes: Biology, Biochemistry, and Implications for Clinical Medicine," *Journal of Molecular Medicine* 73:65–71 (1995).

Kijima et al., "Therapeutic Applications of Ribozymes," *Pharmacology and Therapeutics* 68(2):247–267 (1995).

Kim et al., "Three–dimensional Model of the Active Site of the Self–Splicing rRNA Precursor of Tetrahymena," *Proc. Natl. Acad. Sci. USA* 84:8788–8792 (1987).

Kim et al., "Specific Association of Human Telomerase Activity with Immortal Cells and Cancer," *Science* 266:2011–2015 (1994).

Kisich et al., "Inhibition of TNF–α Secretion by Murine Macrophages Folowing In Vivo and In Vitro Ribozyme Treatment," *Journal of Cellular Biochemistry* 328(19a):221 (1995).

Koizumi et al., "Inhibition of c–Ha–ras Gene Expression by Hammerhead Ribozymes Containing a Stable C(UUCG)G Hairpin Loop," *Biol. Pharm. Bull.*, 16(9):879–883 (1993).

Kornblith, et al., "The Future of Therapy for Glioblastoma," *Surg. Neurol.* 39:538–543, (1993).

Kumar et al., "Mechanistic Studies on Hammerhead Ribozymes," *Nucleic Acids and Molecular Biology* 10:217–230 (1996).

Kung et al., "Structural Basis of Oncogenic Activation of Epidermal Growth Factor Receptor," *Biochemical And Molecular Aspects of Selected Cancers* 2:19–45 (1994).

L'Huillier et al., "Efficacy of Hammerhead Ribozymes Targeting α–Lactalbumin Transcripts: Experiments in Cells and Transgenic Mice," *Nucleic Acids and Molecular Biology* 10:283–299 (1996).

Lamond et al., "Antisense Oligonucleotides Made of 2'–O–alkylRNA: their Properties and Applications in RNA Biochemistry," *FEBS Letters* 325(1,2):123–127 (1993).

Lange et al., "In Vitro and In Vivo Effects of Synthetic Ribozymes Targeted against BCR/ABL mRNA," *Leukemia* 7(11):1786–1794 (1994).

Leopold et al., "Multi–Unit Ribozyme–Mediated Cleavage of bcr–abl mRNA in Myeloid Leukemias," *Blood* 85(8):2162–2170 (1995).

Lesser et al., "The Chemotherapy of High Grade Astrocytomas," *Seminars in Oncology* 21(2):220–235 (1994).

Lewis et al., "Biodegradable Polymer Devices for the Sustained Exogenous Delivery of Ribozymes," *Journal of Cellular Biochemistry* 328(19a):227 (1995).

L'Huillier et al., "Cytoplasmic Delivery of Ribozymes Leads to Efficient Reduction in α–Lactalbumin mRNA Levels in C1271 Mouse Cells," *EMBO J.* 11(12):4411–4418 (1992).

Li and Altman, "Cleavage by RNase P of gene N mRNA reduces bacteriophage λ burst size," *Nucleic Acids Research* 24(5):835–842 (1996).

Liebel et al., "Contemporary Approaches to the Treatment of Malignant Gliomas with Radiation Therapy," *Seminars in Oncology*, 21(2):198–219 (1994).

Lieber et al., "Stable High–Level Gene Expression in Mammalian Cells by T7 Phage RNA Polymerase," *Methods Enzymol.* 217:47–66 (1993).

Lisziewicz et al., "Inhibition of Human Immunodeficiency Virus Type 1 Replication by Regulated Expression of a Polymeric Tat Activation Response RNA Decoy as a Strategy for Gene Therapy in AIDS," *Proc. Natl. Acad. Sci. U.S.A.* 90:8000–8004 (1993).

Loke, et al., "Characterization of Oligonucleotide Transport into Living Cells," *Proceedings of the National Academy of Sciences, USA*, 86:3474–3478, (1989).

Lyngstadaas et al., "A Synthetic, Chemically Modified Ribozyme Eliminates Amelogenin, the Major Translation Product in Developing Mouse Enamel In Vivo," *EMBO Journal* 14(21):5224–5229 (1995).

Marschall et al., "Inhibition of Gene Expression with Ribozymes," *Cellular and Molecular Neurobiology* 14(5):523–538 (1994).

Marschall et al., "Phosphorodithioate DNA as a Potential Therapeutic Drug," *Science* 259:1564–1569 (1993).

Martuza, "Experimental Therapy of Human Glioma by Means of a Genetically Engineered Virus Mutant," *Science* 252:854–855 (1991).

McGarry et al., "Inhibition of Heat Shock Protein Synthesis by Heat–Inducible Antisense RNA," *Proc. Natl. Acad. Sci. USA* 83:399–403 (1986).

Michels and Pyle, "Conversion of a Group II Intron into a New Multiple–Turnover Ribozyme that Selectively Cleaves Oligonucleotides: Elucidation of Reaction Mechanism and Structure/Function Relationships," *Biochemistry* 34:2965–2977 (1995).

Miller et al., "A Satellite RNA of Barley Yellow Dwarf Virus Contains a Novel Hammerhead Structure in the Self–Cleavage Domain," *Virology* 183:711–720 (1991).

Milligan et al., "Synthesis of Small RNAs Using T7 RNA Polymerase," *Methods Enzymol.* 180:51–62 (1989).

Milligan et al., "Current Concepts in Antisense Drug Design," *Journal of Medicinal Chemistry* 36(14):1923–1937 (1993).

Modjtahedi et al., *International Journal of Cancer*, 4:277–296 (1994).

Morvan et al., "Modified Oligonucleotides: IV Solid Phase Synthesis and Preliminary Evaluation of Phosphorothioate RNA as Potential Antisense Agents." *Tetrahedron Letters* 31(49):7149–7152 (1990).

Ohkawa et al., "Activities of HIV–RNA Targeted Ribozymes Transcribed From a 'Shot–Gun' Type Ribozyme–Trimming Plasmid," *Nucleic Acids Symp. Ser.* 27:15–16 (1992).

Ohkawa et al., "Ribozymes: From Mechanistic Studies to Applications In Vivo," *Journal of Biochemistry* 118:251–258 (1995).

Ojwang et al., "Inhibition of Human Immunodeficiency Virus Type 1 Expression by a Hairpin Ribozyme," *Proc. Natl. Acad. Sci. USA* 89:10802–10806 (1992).

Olsen et al., "Study of a Hammerhead Ribozyme Containing 2'–Modified Adenosine Residues," *Biochemistry* 30:9735–9741 (1991).

Ostrowski et al., "Genetic Alterations and Gene Expression In Human Malignant Glioma," *Biochemical and Molecular Aspects of Selected Cancers* 2:143–168 (1994).

Paolella et al., "Nuclease resistant ribozymes with high catalytic activity," *EMBO Journal* 11(5):1913–1919 (1992).

Perreault et al., "Mixed Deoxyribo– and Ribo–Oligonucleotides with Catalytic Activity," *Nature* 344:565–567 (1990).

Perriman et al., "Effective Ribozyme Delivery in Plant Cells (Abstract)," *Proc. Natl. Acad. Sci. USA* 92:6175–79 (1995).

Perriman et al., "Extended Target–Site Specifically for a Hammerhead Ribozyme," *Gene* 113:157–163 (1992).

Perrotta et al., "Cleavage of Oligoribonucleotides by a Ribozyme Derived from the Hepatitis δ Virus RNA Sequence," *Biochemistry* 31:16–21 (1992).

Pieken et al., "Kinetic Characterization of Ribonuclease–Resistant 2'–Modified Hammerhead Ribozymes," *Science* 253:314–317 (1991).

Pley et al., Three Dimensional Structure of a Hammerhead Ribozyme *Nature* 372:68–74 (1994).

Ponten, et al., "Long Term Culture of Normal and Neoplastic Human GLIA," *Acta Path. Microbiol. Scandinav.*, 74:465–486 (1968).

Puttaraju et al., "A Circular Trans–Acting Hepatitis Delta Virus Ribozyme," *Nucleic Acids Research* 21(18):4253–4258 (1993).

Rawls, "Ribozymes Move Closer to Applications for AIDS Therapy," *Chemical and Engineering News* 74(5):26–28 (1996).

Reddy, "Antisense Oligonucleotides: A New Class of Potential Anti–AIDS and Anticancer Drugs," *Drugs of Today* 32(2):113–137 (1996).

Rhyu, "Telomeres, Telomerase, and Immortality," *Journal of the National Cancer Institute* 87(12):884–894 (1995).

Ringertz, "Grading of Gliomas," *Acta. Pathol. Microbiol. Scand.*, 27:51–64, (1950).

Rossi et al., "Ribozymes as Anti–HIV–1 Therapeutic Agents: Principles, Applications, and Problems," *AIDS Research and Human Retroviruses* 8(2):183–189 (1992).

Rossi, "Controlled, Targeted, Intracellular Expression of Ribozymes: Progress and Problems," *TIBTECH* 13:301–305 (1995).

Rossi, "Making Ribozymes Work in Cells," *Current Biology* 4(5):469–471 (1994).

Ruffner et al., "Sequence Requirements of the Hammerhead RNA Self–Cleavage Reaction," *Biochemistry* 29:10695–10702 (1990).

Ruffner et al., "Thiophosphate Interference Experiments Locate Phosphates Important for the Hammerhead RNA Self–Cleavage Reaction," *Nucleic Acids Research* 18(20):6025–6029 (1990).

Sambrook, *Molecular Cloning: A Laboratory Manual*, Second Edition, Vols 1,2 & 3. Cold Springs Harbor, Laboratory Press (1989).

Sarver et al., "Ribozymes as Potential Anti–HIV–1 Therapeutic Agents" *Science* 247:1222–1225 (1990).

Saville et al., "A Site–Specific Self–Cleavage Reaction Performed by a Novel RNA In Neurospora Mitochondria," *Cell* 61:685–696 (1990).

Saville et al., "RNA–Mediated Ligation of Self–Cleavage Products of a Neurospora Mitochondrial Plasmid Transcript," *Proc. Natl. Acad. Sci. USA* 88:8826–8830 (1991).

Scanlon et al., "Ribozyme–Mediated Cleavage of c–fos mRNA Reduces Gene Expression of DNA Synthesis Enzymes and Metallothionein," *Proc. Natl. Acad. Sci. USA* 88:10591–10595 (1991).

Scaringe et al., "Chemical Synthesis of Biologically Active Oligoribonucleotides using β–cyanoethyl Protected Ribonucleoside Phosphoramidites," *Nucl Acids Res.* 18(18):5433–5441 (1990).

Scott et al., "The Crystal Structure of an All–RNA Hammerhead Ribozyme: A Proposed Mechanism for RNA Catalytic Cleavage," *Cell* 81:991–1002 (1995).

Sczakiel et al., "Antisense Principle or Ribozyme Action?" *Biol. Chem. Hoppe–Seyler* 375:745–746 (1994).

Sczakiel et al., "Computer–Aided Search for Effective Antisense RNA Target Ssequences of the Human Immunodeficiency Virus Type 1," *Antisense Research and Development* 3:45–52 (1993).

Sczakiel, "Hammerhead Ribozymes with Long Flanking Sequences: a Structural and Kinetic View," *Nucleic Acids and Molecular Biology* 10:231–241 (1996).

Shaw et al., "Modified deoxyoligonucleotides Stable to Exonuclease Degradation in Serum," *Nucleic Acids Research* 19(4):747–750 (1991).

Shibahara et al., "Inhibition of Human Immunodeficiency Virus (HIV–1) Replication by Synthetic Oligo–RNA Derivatives," *Nucleic Acids Research* 17(1):239–252 (1989).

Shimayama et al., "Generality of the NUX Rule: Kinetic Analysis of the Results of Systematic Mutations in the Trinucleotide at the Cleavage Site of Hammerhead Ribozymes," *Biochemistry* 34:3649–3654 (1995).

Shimayama et al., "Nuclease–resistant chimeric ribozymes containing deoxyribonucleotides and phosphorothioate linkages," *Nucleic Acids Research* 21(11):2605–2611 (1993).

Shoji, et al., "Cellular Uptake and Biological Effects of Antisense Oligodeoxynucleotide Analogs Targeted to Herpes Simplex Virus," *Antimicrobial Agents and Chemotherapy*, 40(7):1670–1675 (1996).

Shoji, et al., "Mechanism of Cellular Uptake of Modified Oligodeoxynucleotides Containing Methylphosphonate Linkages," *Nucleic Acids Research* 19(20):5543–5550 (1991).

Sioud et al., "Preformed Ribozyme Destroys Tumour Necrosis Factor mRNA in Human Cells," *Journal of Molecular Biology* 223:831–835 (1992).

Snyder et al., "Ribozyme–Mediated Inhibition of bcr–abl Gene Expression in a Philadelphia Chromosome–Positive Cell Line," *Blood* 82(2):600–605 (1993).

Sporn et al., "Autocrine Growth Factors and Cancer," *Nature* 313:745–747 (1985).

Sproat, "Synthetic Catalytic Oligonucleotides Based on the Hammerhead Ribozyme," *Nucleic Acids and Molecular Biology* 10:265–281 (1996).

Stein et al., "Antisense Oligonucleotides as Therapeutic Agents–Is the Bullet Really Magical?," *Science* 261:1004–1012 (1993).

Stein et al., "Phosphorothioate and Normal Oligodeoxyribonucleotides with 5'–linked acridine: characterization and preliminary kinetics of cellular uptake," *Gene* 72(1–2):333–341 (1988).

Suh et al., "Systematic Substitution of Individual Bases in Two Important Single–Stranded Regions of the HDV Ribozyme for Evaluation of the Role Specific Bases," *FEBS Letters* 326(1,2,3):158–162 (1993).

Sullenger et al., "Tethering Ribozymes to a Retroviral Packaging Signal for Destruction of Viral RNA," *Science* 262:1566–1569 (1993).

Sullivan, "Development of Ribozymes for Gene Therapy," *Journal of Investigative Dermatology* 103(5):85S–89S (1994).

Sullivan, "Liposome–Mediated Uptake of Ribozymes," *A Companion to Methods in Enzymology* 5(1):61–66 (1993).

Symons, "Ribozymes," *Current Opinion in Structural Biology* 4(3):322–330 (1994).

Symons, "Small Catalytic RNA's," *Annual Review of Biochemistry* 61:641–671 (1992).

Szostak, "Evolution ex vivo," *Nature* 361(6408):119–120 (1993).

Taira et al., "Construction of a novel RNA–transcript–trimming plasmid which can be used both in vitro in place of run–off and (G)–free transcriptions and in vivo as multi–sequences transcription vectors," *Nucleic Acids Research* 19(19):5125–5130 (1991).

Tayler et al., "Chimeric DNA–RNA hammerhead ribozymes have enhanced in vitro catalytic efficiency and increased stability in vivo," *Nucleic Acids Research* 20(17):4559–4565 (1992).

Theirry et al., Liposomes as a Delivery System for Antisense and Ribozyme Compounds, *Delivery Strategies for Antisense Oligonucleotide Therapeutics*, pp. 199–220, London CRC Press.

Thompson et al., "Improved Accumulation and Activity of Ribozymes Expressed from a tRNA–based RNA Polymerase III Promoter," *Nucleic Acids Research* 23(12):2259–2268 (1995).

Thompson et al., "Ribozymes in Gene Therapy," *Nature Medicine* 1(3):277–278 (1995).

Thomson et al., "Activity of hammerhead ribozymes containing non–nucleotides linkers," *Nucleic Acids Research* 21:5600–5603 (1993).

Thomson et al., "The Hammerhead Ribozyme," *Nucleic Acids and Molecular Biology* 10:172–196 (1996).

Tidd et al., "Partial Protection of Oncogene, Anti–sense Oligodeoxynucleotides Against Serum Nuclease Degradation Using Terminal Methylphosphonate Groups," *British Journal of Cancer* 60:343–350 (1989).

Tsuchihashi et al., "Protein Enhancement of Hammerhead Ribozyme Catalysis," *Science* 262:99–102 (1993).

Tuschl et al., "A Three Dimensional Model for the Hammerhead Ribozyme based on Fluorescence Measurements" *Science* 266:785–788 (1995).

Tuschl et al., "Hammerhead Ribozymes: Importance of Stem–loop II for Activity," *Proc. Natl Acad. Sci. USA* 90:6991–6994 (1993).

Uhlenbeck, "A Small Catalytic Oligoribonucleotide," *Nature* 328:596–600 (1987).

Ullrich et al., "Human Epidermal Growth Factor Receptor CDNA Sequence and Aberrant Expression of the Amplified Gene in A431 Epidermoid Carcinoma Cells," *Nature* 309:418–425 (1984).

Usman and McSwiggen, "Ch. 30—Catalytic RNA (Ribozymes) as Drugs," *Annual Reports in Medicinal Chemistry* 30:285–294 (1995).

Usman et al., "Automated Chemical Synthesis of Long Oligoribonucleotides Using 2'–O–Silylated Ribonucleoside 3'–O–Phosphoramidites on a Controlled–Pore Glass Support: Synthesis of a 43–Nucleotide Sequence Similar to the 3'–Half Molecule of an *Escherichia coli* Formylmethionine tRNA," *J. Am. Chem. Soc.* 109(25):7845–7854 (1987).

Usman et al., "Chemical Modification of Hammerhead Ribozymes: Activity and Nuclease Resistance," *Nucleic Acids Symposium Series* 31:163–164 (1994).

Usman et al., "Exploiting the Chemical Synthesis of RNA," *TIBS* 17:334–339 (1992).

Usman et al., "Design, Synthesis, and Function of Therapeutic Hammerhead Ribozymes," *Nucleic Acids and Molecular Biology* 10:243–263 (1996).

Ventura et al., "Activation of HIV–Specific Ribozyme Activity by Self–Cleavage," *Nucleic Acids Research* 21(14):3249–3255 (1993).

Weerasinghe et al., "Resistance to Human Immunodeficiency Virus Type 1 (HIV–1) Infection in Human CD4$^+$ Lymphocyte–Derived Cell Lines Conferred by Using Retroviral Vectors Expressing and HIV–1 RNA–Specific Ribozyme," *Journal of Virology* 65(10):5531–5534 (1991).

Werner et al., "The Effect of Base Mismatches in the Substrate Recognition Helices of Hammerhead Ribozymes on Binding and Catalysis," *Nucleic Acids Research* 23(12):2092–2096 (1995).

Williams et al., "Function of specific 2'–hydroxyl groups of guanosines in a hammerhead ribozyme probed by 2' modifications," *Proc. Natl. Acad. Sci. USA* 89:918–921 (1992).

Wincott et al., "Synthesis, Deprotection, Analysis and Purification of RNA and Ribozymes," *Nucleic Acids Research* 23(14):2677–2684 (1995).

Wong et al., "The Molecular Biology and Molecular Genetics of Astrocytic Neoplasms," *Seminars in Oncology*, 21(2):139–148 (1994).

Wu et al., "Human hepatitis δ virus RNA subfragments contain an autocleavage activity," *Proc. Natl. Acad. Sci. USA* 86:1831–1835 (1989).

Wu–Pong et al., "Antisense c–myc Oligonucleotide Cellular Uptake and Activity," *Antisense Research and Development*, 4:155–163 (1994).

Yakubov et al., "Mechanism of Oligonucleotide Uptake by Cells: Involvement of Specific Receptors?" *Proc. Natl. Acad. Sci. USA* 86:6454–6458 (1989).

Yamazaki et al., "Cleavage of Glioma–Specific Aberrant mRNA of Epidermal Growth Factor Receptor (EGFR) by Ribozyme In Vitro," *Proc. Amer. Assoc. for Cancer Research Annual Meeting* 36:429 (1995).

Yang et al., "Minimum Ribonucleotide Requirement for Catalysis by the RNA Hammerhead Domain," *Biochemistry* 31:5005–5009 (1992).

Young et al., "Systematic Substitution of the Individual Bases in two Important Single–Stranded Regions of the HDV Ribozyme for the Evaluation of the Role Specific Bases," *FEBS Letters* 326(1,2,3):158–162 (1993).

Yu et al., "A Hairpin Ribozyme Inhibits Expression of Diverse Strains of Human Immunodeficiency Virus Type 1," *Proc. Natl. Acad. Sci. USA* 90:6340–6344 (1993).

Zabner et al., "Adenovirus–Mediated Gene Transfer Transiently Corrects the Chloride Transport Defect in Nasal Epithelia of Patients with Cystic Fibrosis," *Cell* 75:207–216 (1993).

Zaug et al., "The Tetrahymena Ribozyme Acts Like an RNA Restriction Endonuclease," *Nature* 324:429–433 (1986).

Zhou et al., "Synthesis of Functional mRNA in Mammalian Cells by Bacteriophage T3 RNA Polymerase," *Mol. Cell. Biol.* 10(9):4529–4537 (1990).

Zuker et al., "A Comparison of Optimal and Suboptimal RNA Secondary Structures Predicted by Free Energy Minimization with Structures Determined by Phylogenetic Comparison," *Nucleic Acids Research* 19(10):2707–2714 (1991).

* cited by examiner

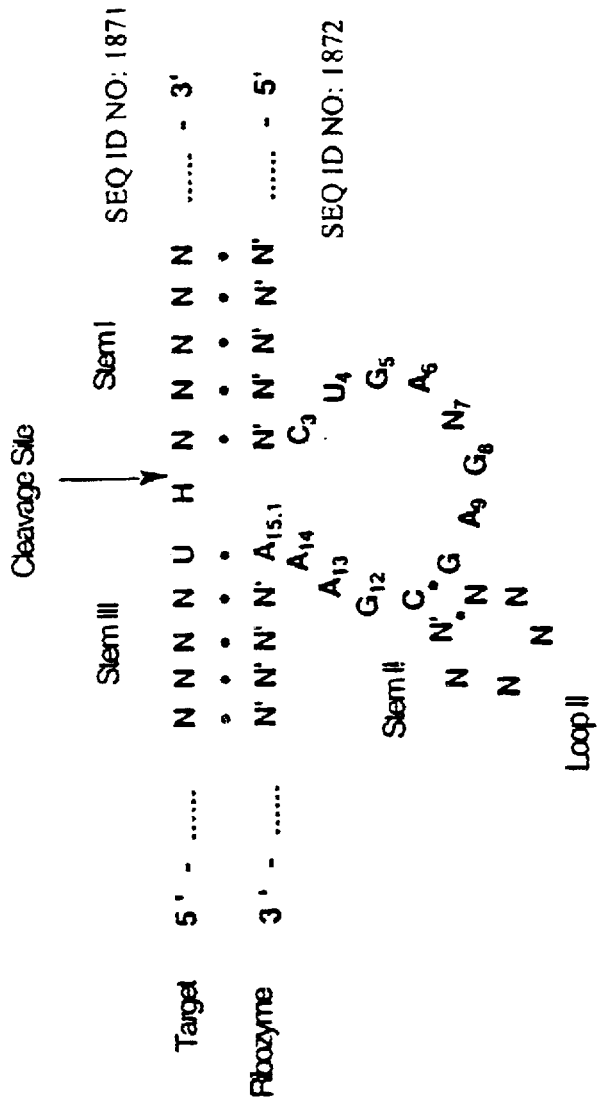
Figure 1. Hammerhead Ribozyme

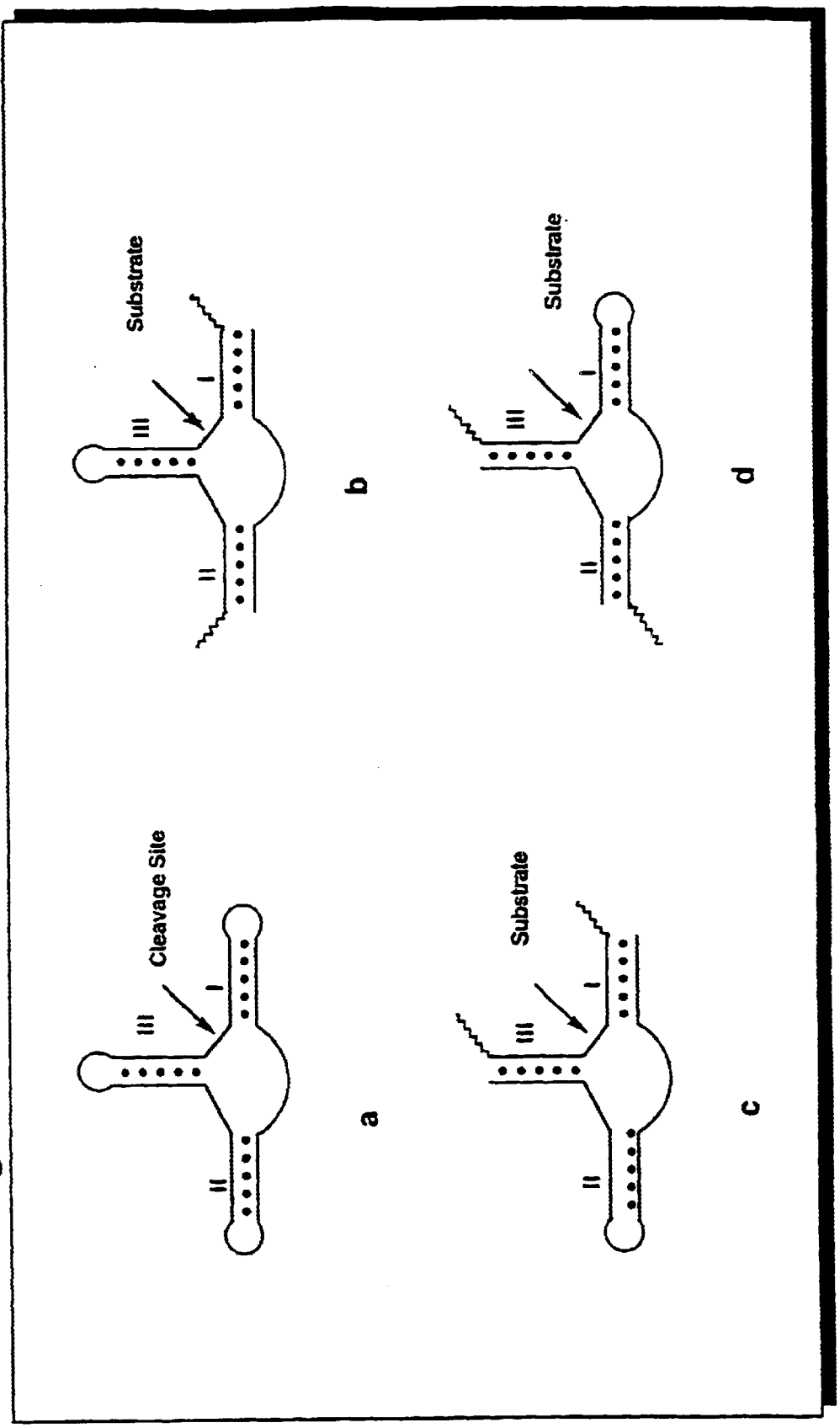
Figure 2. Hammerhead Ribozyme Substrate Motifs

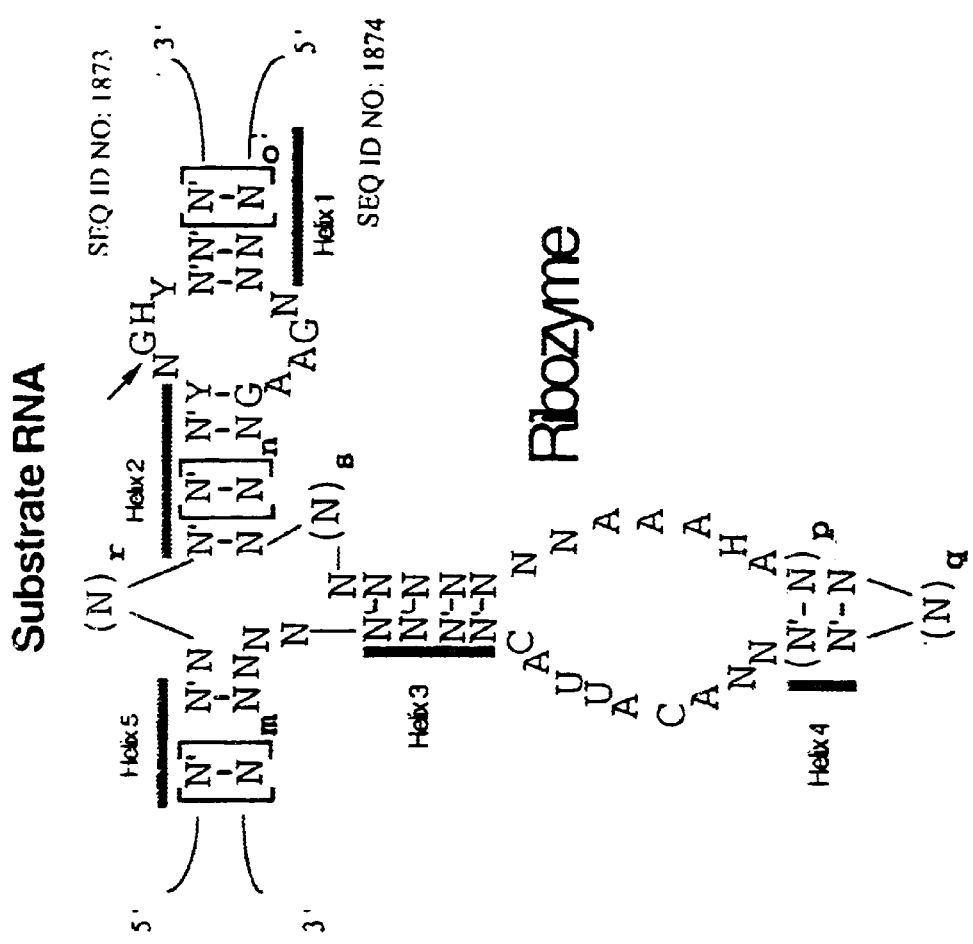
*Figure 3. Hairpin Ribozyme*

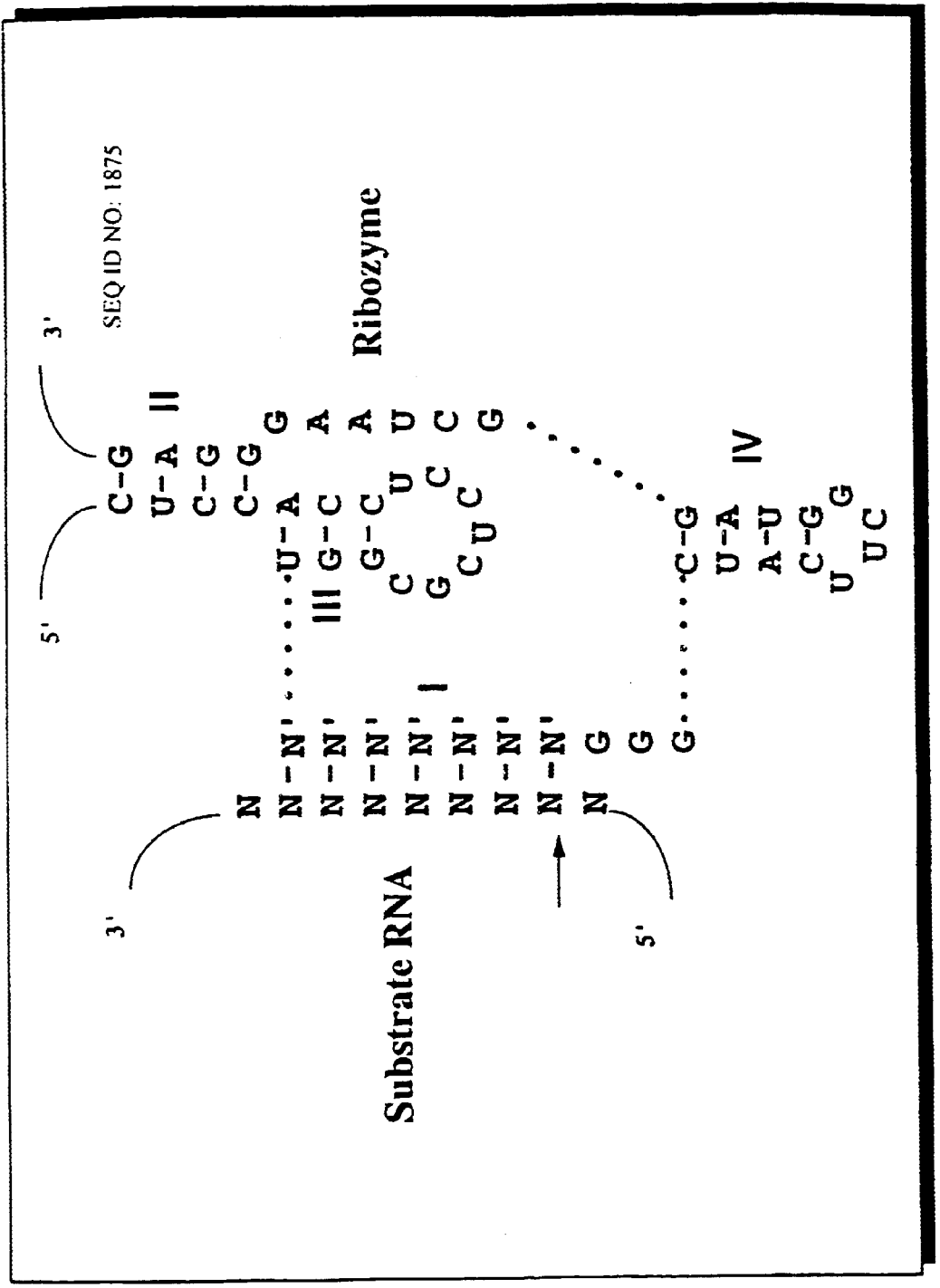
Figure 4. Hepatitis Delta Virus (HDV) Ribozyme

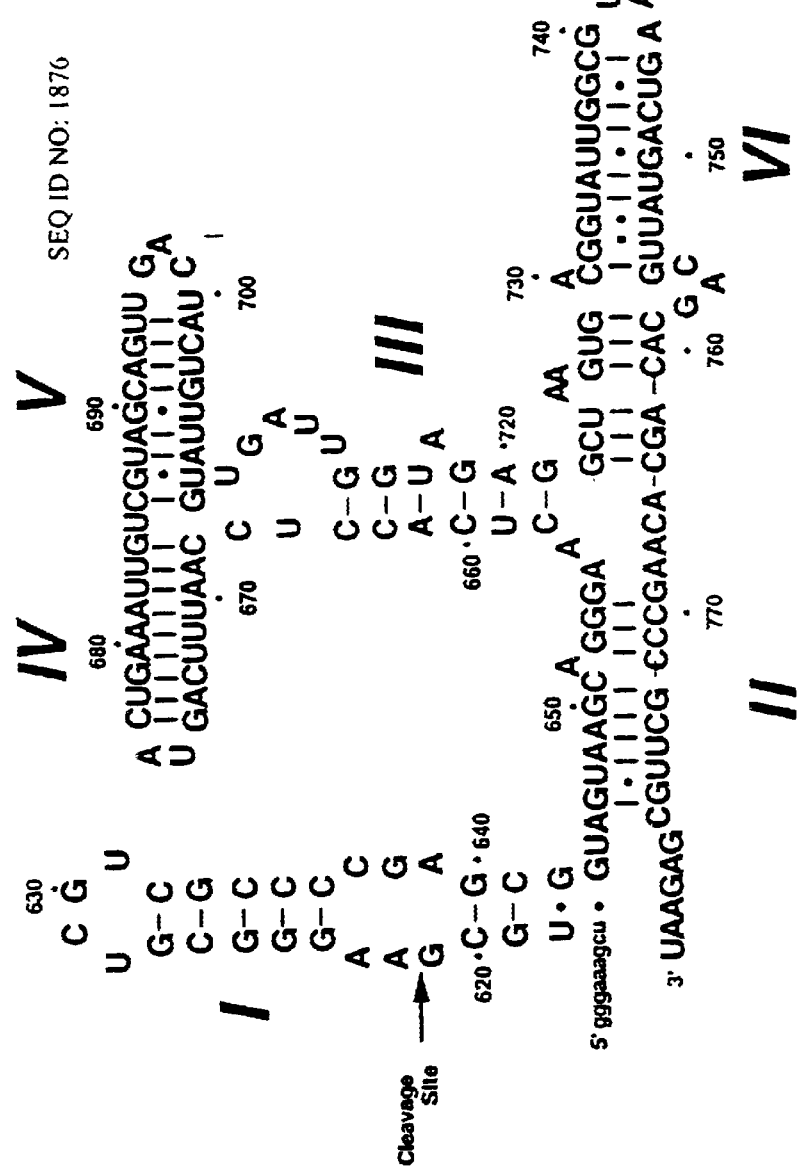
Figure 5. Neurospora VS Ribozyme

Figure 6a  RNA Cleavage by EGF-R Ribozymes
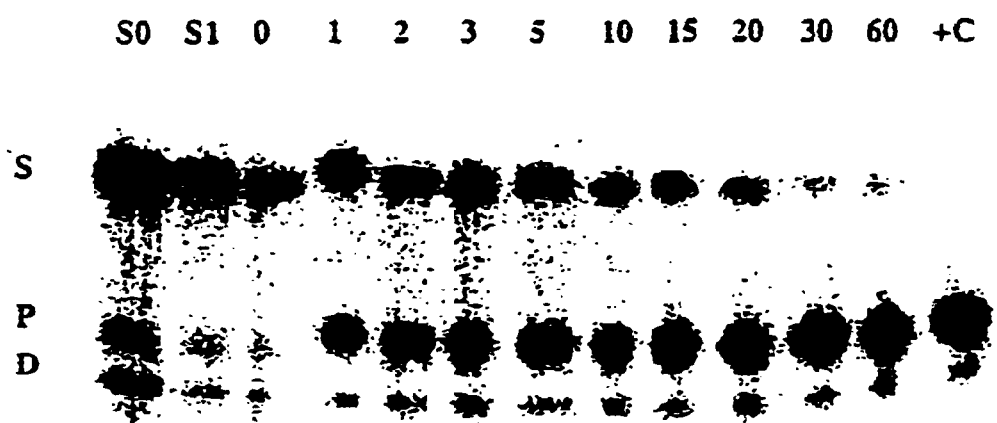
Figure 6b
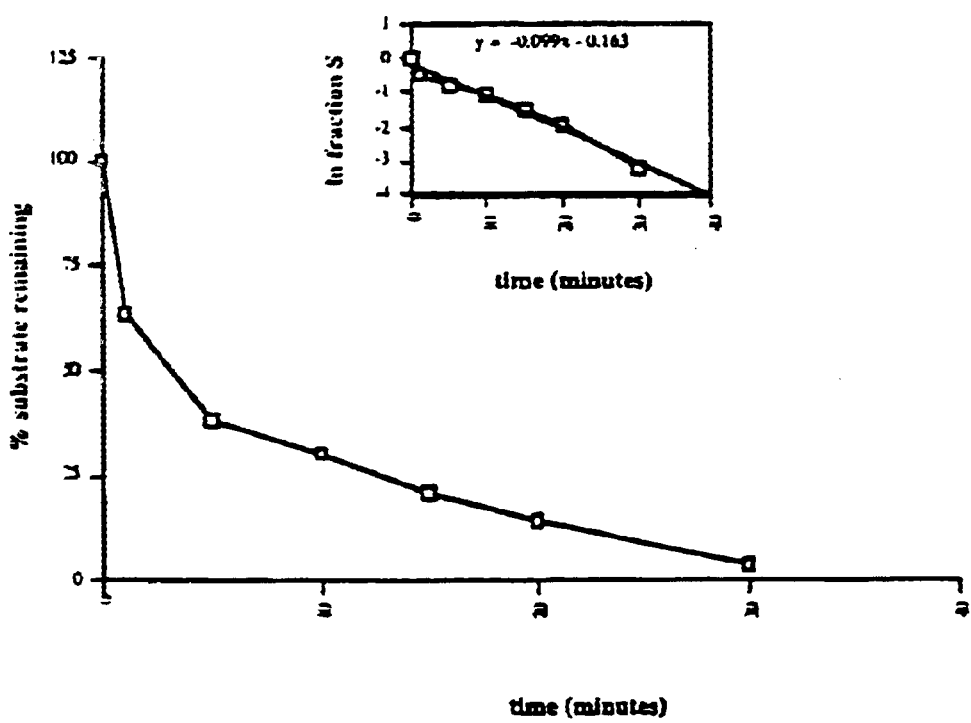

Figure 7a  Kinetics of RNA Cleavage by EGF-R Ribozymes
10nM ribozyme : 300nM substrate
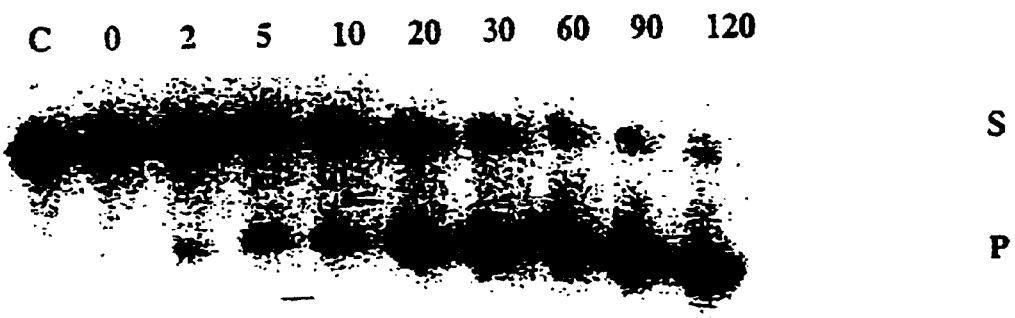
Figure 7b
  10nM ribozyme : 1μM substrate
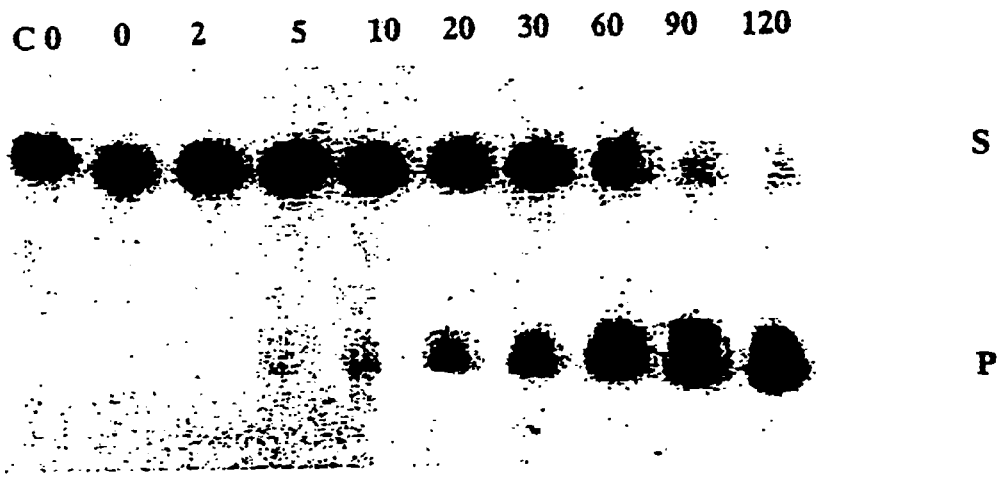

Figure 8: Amino Hammerhead Ribozyme
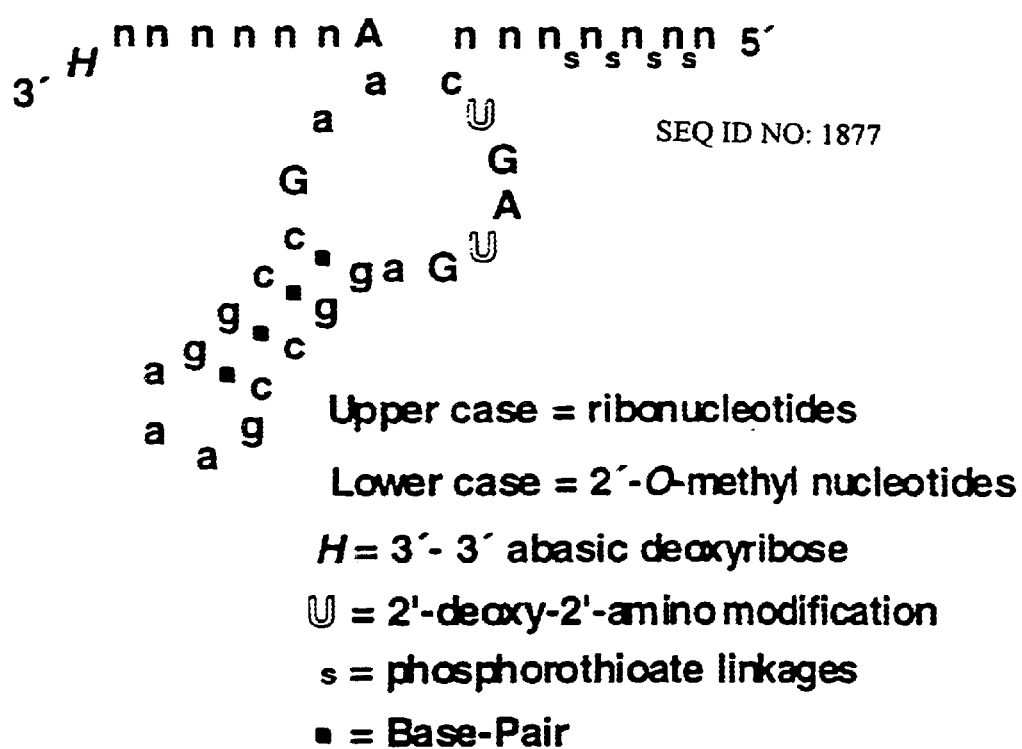
SEQ ID NO: 1877
Upper case = ribonucleotides
Lower case = 2´-O-methyl nucleotides
H = 3´- 3´ abasic deoxyribose
U = 2'-deoxy-2'-amino modification
s = phosphorothioate linkages
■ = Base-Pair

Figure 9: C-Allyl Hammerhead Ribozyme
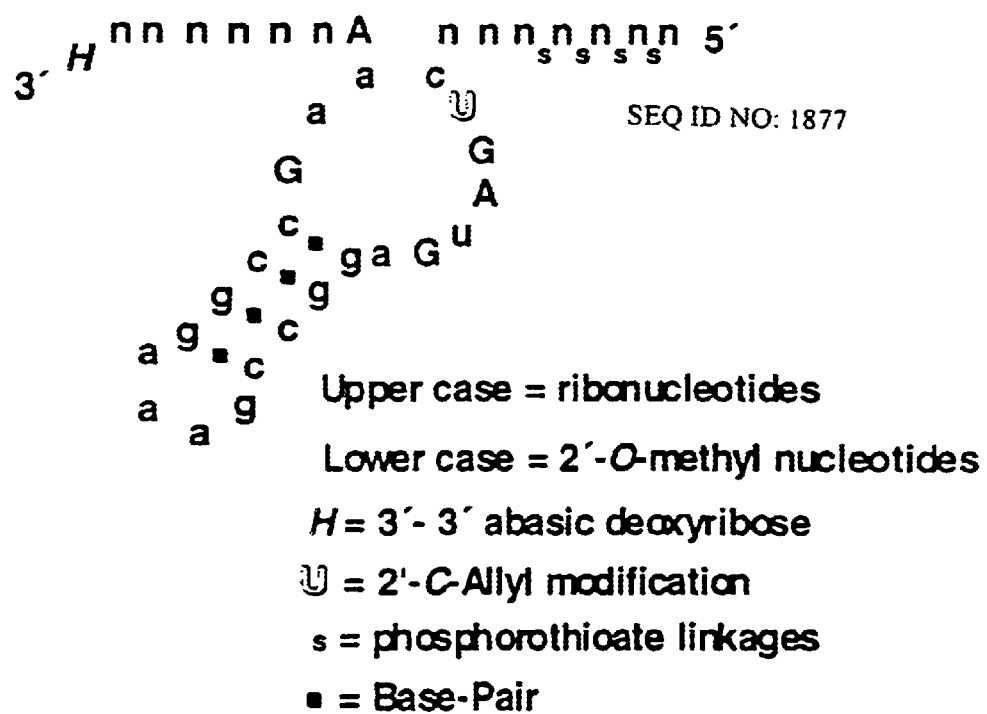
SEQ ID NO: 1877
Upper case = ribonucleotides
Lower case = 2'-O-methyl nucleotides
H = 3'- 3' abasic deoxyribose
U = 2'-C-Allyl modification
s = phosphorothioate linkages
■ = Base-Pair

ENZYMATIC NUCLEIC ACID TREATMENT OF DISEASES OF CONDITIONS RELATED TO LEVELS OF EPIDERMAL GROWTH FACTOR RECEPTORS

CROSS REFERENCE TO RELATED APPLICATION

This application is a continuation of U.S. Ser. No. 08/985,162, filed Dec. 4, 1997, now U.S. Pat. No. 6,057,156 which claims the benefit of Saghir Akhtar et al., U.S. Provisional Application No. 60/036,476, entitled "Enzymatic Nucleic Acid Treatment of Diseases or Conditions Related to Levels of Epidermal Growth Factor Receptors", filed Jan. 31, 1997, which is hereby incorporated herein by reference in its entirety, including any drawings and figures.

BACKGROUND OF THE INVENTION

The present invention concerns therapeutic compositions and methods for the treatment of cancer.

The present invention relates to therapeutic compositions and methods for the treatment or diagnosis of diseases or conditions related to EGFR expression levels, such as cancer. The following summary is not meant to be complete and is provided only for understanding of the invention that follows. This summary is not an admission that any of the work described below is prior art to the claimed invention.

The epidermal growth factor receptor (EGFR) is a 170 kDa transmembrane glycoprotein consisting of an extracellular 'ligand' binding domain, a transmembrane region and an intracellular domain with tyrosine kinase activity (Kung et al., 1994). The binding of growth factors to the EGFR results in down regulation of the ligand-receptor complex, autophosphorylation of the receptor and other protein substrates, leading ultimately to DNA synthesis and cell division. The external ligand binding domain is stimulated by EGF and also by TGFα, amphiregulin and some viral growth factors (Modjtahedi & Dean, 1994).

The EGFR gene (c-erbB1), is located on chromosome 7, and is homologous to the avian erythroblastosis virus oncogene (v-erbB), which induces malignancies in chickens. The v-erbB gene codes for a truncated product that lacks the extracellular ligand binding domain. The tyrosine kinase domain of the EGFR has been found to have 97% homology to the v-erbB transforming protein (Downward et al., 1984).

EGFR is overexpressed in a number of malignant human tissues when compared to their normal tissue counterparts (for review see Khazaie et al., 1993). The gene for the receptor is both amplified and overexpressed in a number of cancer cells. Overexpression of the EGFR is often accompanied by the co-expression of the growth factors EGF and TGFα, suggesting that an autocrine pathway for control of growth may play a major part in the progression of tumors (Spom & Roberts, 1985).

Growth factors and their receptors may play a role in the development of human brain tumors. A high incidence of overexpression, amplification, deletion and structural rearrangement of the gene coding for the EGFR has been found in biopsies of brain tumors (Ostrowski et al., 1994). In fact the amplification of the EGFR gene in glioblastoma multiforme tumors is one of the most consistent genetic alterations known, with the EGFR being overexpressed in approximately 40% of malignant gliomas (Black, 1991). It has also been demonstrated that in 50% of glioblastomas, amplification of the EGFR gene is accompanied by the co-expression of mRNA for at least one or both of the growth factors EGF and TNFα (Ekstrand et al., 1991).

The amplified genes are frequently rearranged and associated with polymorphism leading to abnormal protein products (Wong et al., 1994). The rearrangements that have been characterized usually show deletions of part of the extracellular domain, resulting in the production of an EGFR protein that is smaller in size. Three classes of deletion mutant EGF receptor genes have been identified in glioblastoma tumors. Type I mutants lack the majority of the external domain, including the ligand binding site, type II mutants have a deletion in the domain adjacent to the membrane but can still bind ligands and type III, which is the most common and found in 17% of glioblastomas, have a deletion of 267 amino acids spanning domains I and II of the EGFR.

In addition to glioblastomas, abnormal EGFR expression has also been reported in a number of squamous epidermoid cancers and breast cancers (reviewed in Kung et al, 1994; Modjtahedi & Dean, 1994). Many patients with tumors that overexpress the EGFR have a poorer prognosis than those who do not (Khazaie et al., 1993). Consequently, therapeutic strategies which can potentially inhibit or reduce the aberrant expression of the EGFR receptor are of great interest as potential anti-cancer agents.

SUMMARY OF THE INVENTION

This invention relates to ribozymes, or enzymatic nucleic acid molecules, directed to cleave RNA species that are required for cellular growth responses. In particular, applicant describes the selection and function of ribozymes capable of cleaving RNA encoded by the receptor of epidernmal growth factor (EGFR). Such ribozymes may be used to inhibit the hyper-proliferation of tumor cells in one or more cancers.

In the present invention, ribozymes that cleave EGFR RNA are described. Those of ordinary skill in the art will understand that from the examples described that other ribozymes that cleave target RNAs required for cell proliferation may be readily designed and are within the invention. Such RNAs may have at least 90% homology to EGFR in humans with a normal EGFR gene.

By "inhibit" is meant that the activity of EGFR or level of RNAs encoded by EGFR is reduced below that observed in the absence of the nucleic acid, particularly, inhibition with ribozymes preferably is below that level observed in the presence of an inactive RNA molecule able to bind to the same site on the mRNA, but unable to cleave that RNA.

By "enzymatic nucleic acid molecule" it is meant a nucleic acid molecule which has complementarity in a substrate binding region to a specified gene target, and also has an enzymatic activity which is active to specifically cleave RNA in that target. That is, the enzymatic nucleic acid molecule is able to intermolecularly cleave RNA and thereby inactivate a target RNA molecule. This complementarity functions to allow sufficient, hybridization of the enzymatic nucleic acid molecule to the target RNA to allow the cleavage to occur. One hundred percent complementarity is preferred, but complementarity as low as 50–75% may also be useful in this invention.

The term enzymatic nucleic acid is used interchangeably with phrases such as ribozymes, catalytic RNA, enzymatic RNA, catalytic DNA, nucleozyme, DNAzyme, RNA enzyme, endoribonuclease, minizyme, leadzyme, oligozyme or DNA enzyme, as used in the art. All of these terminologies describe nucleic acid molecules with enzymatic activity.

By "equivalent" RNA to EGFR is meant to include those naturally occurring RNA molecules associated with cancer in various animals, including human.

By "complementarity" is meant a nucleic acid that can form hydrogen bond(s) with another RNA sequence by either traditional Watson-Crick or other non-traditional types (for example, Hoogsteen type) of base-paired interactions.

Seven basic varieties of naturally-occurring enzymatic RNAs are known presently. Each can catalyze the hydrolysis of RNA phosphodiester bonds in trans (and thus can cleave other RNA molecules) under physiological conditions. Table I summarizes some of the characteristics of these ribozymes. In general, enzymatic nucleic acids act by first binding to a target RNA. Such binding occurs through the target binding portion of an enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

The enzymatic nature of a ribozyme is advantageous over other technologies, since the concentration of ribozyme necessary to affect a therapeutic treatment is lower. This advantage reflects the ability of the ribozyme to act enzymatically. Thus, a single ribozyme molecule is able to cleave many molecules of target RNA. In addition, the ribozyme is a highly specific inhibitor, with the specificity of inhibition depending not only on the base-pairing mechanism of binding to the target RNA, but also on the mechanism of target RNA cleavage. Single mismatches, or base-substitutions, near the site of cleavage can be chosen to completely eliminate catalytic activity of a ribozyme.

Nucleic acid molecules having an endonuclease enzymatic activity are able to repeatedly cleave other separate RNA molecules in a nucleotide base sequence-specific manner. Such enzymatic RNA molecules can be targeted to virtually any RNA transcript, and efficient cleavage achieved in vitro (Zaug et al., 324, *Nature* 429 1986; Uhlenbeck, 1987 *Nature* 328, 596; Kim et al., 84 *Proc. Natl. Acad. Sci. USA* 8788, 1987; Dreyfus, 1988, *Einstein Quart. J. Bio. Med.*, 6, 92; Haseloff and Gerlach, 334 *Nature* 585, 1988; Cech, 260 *JAMA* 3030, 1988; and Jefferies et al., 17 *Nucleic Acids Research* 1371, 1989).

Because of their sequence-specificity, trans-cleaving ribozymes show promise as therapeutic agents for human disease (Usman & McSwiggen, 1995 *Ann. Rep. Med. Chem.* 30, 285–294; Christoffersen and Marr, 1995 *J. Med. Chem.* 38, 2023–2037). Ribozymes can be designed to cleave specific RNA targets within the background of cellular RNA. Such a cleavage event renders the RNA non-functional and abrogates protein expression from that RNA. In this manner, synthesis of a protein associated with a disease state can be selectively inhibited.

Ribozymes that cleave the specified sites in EGFR RNAs represent a novel therapeutic approach to treat diseases, such as cancer and other conditions. Applicant indicates that ribozymes are able to inhibit the activity of EGFR and that the catalytic activity of the ribozymes is required for their inhibitory effect. Those of ordinary skill in the art, will find that it is clear from the examples described that other ribozymes that cleave these sites in EGFR RNAs may be readily designed and are within the scope of this invention.

In one of the preferred embodiments of the inventions herein, the enzymatic nucleic acid molecule is formed in a hammerhead or hairpin motif, but may also be formed in the motif of a hepatitis δ virus, group I intron, group II intron or RNaseP RNA (in association with an RNA guide sequence) or Neurospora VS RNA. Examples of such hammerhead motifs are described by Dreyfus, supra, Rossi et al., 1992, *AIDS Research and Human Retroviruses* 8, 183; of hairpin motifs by Hampel et al., EP0360257, Hampel and Tritz, 1989 *Biochemistry* 28, 4929, Feldstein et al., 1989, *Gene* 82, 53, Haseloff and Gerlach, 1989, *Gene,* 82, 43, and Hampel et al., 1990 *Nucleic Acids Res.* 18, 299; of the hepatitis δ virus motif is described by Perrotta and Been, 1992 *Biochemistry* 31, 16; of the RNaseP motif by Guerrier-Takada et al., 1983 *Cell* 35, 849; Forster and Altman, 1990, *Science* 249, 783; Li and Altman, 1996, *Nucleic Acids Res* 24, 835; Neurospora VS RNA ribozyme motif is described by Collins (Saville and Collins, 1990 *Cell* 61, 685–696; Saville and Collins, 1991 *Proc. Natl. Acad. Sci. USA* 88, 8826–8830; Collins and Olive, 1993 *Biochemistry* 32, 2795–2799; Guo and Collins, 1995, *EMBO. J.* 14, 363); Group II introns are described by Griffin et al., 1995, *Chem. Biol.* 2, 761; Michels and Pyle, 1995, *Biochemistry* 34, 2965; Pyle et al., International PCT Publication No. WO 96/22689; and of the Group I intron by Cech et al., U.S. Pat. No. 4,987,071. These specific motifs are not limiting in the invention and those skilled in the art will recognize that all that is important in an enzymatic nucleic acid molecule (or multiple fragments of such molecules) of this invention is that it has a specific substrate binding site or arm(s) which is complementary to one or more of the target gene RNA regions, and that it have nucleotide sequences within or surrounding that substrate binding site which impart an RNA cleaving activity to the molecule (enzymatic portion).

By "enzymatic portion" is meant that part of the ribozyme essential for cleavage of an RNA substrate.

By "substrate binding arm" is meant that portion of a ribozyme which is complementary to (i.e., able to base-pair with) a portion of its substrate. Generally, such complementarity is 100%, but can be less if desired. For example, as few as 10 bases out of 14 may be base-paired. Such arms are shown generally in FIGS. 1–3 as discussed below. That is, these arms contain sequences within a ribozyme which are intended to bring ribozyme and target RNA together through complementary base-pairing interactions; e.g., ribozyme sequences within stems I and III of a standard hammerhead ribozyme make up the substrate-binding domain (see FIG. 1).

In a preferred embodiment the invention provides a method for producing a class of enzymatic cleaving agents which exhibit a high degree of specificity for the RNA of a desired target. The enzymatic nucleic acid molecule is preferably targeted to a highly conserved sequence region of a target mRNAs encoding EGFR proteins such that specific treatment of a disease or condition can be provided with either one or several enzymatic nucleic acids. Such enzymatic nucleic acid molecules can be delivered exogenously to specific cells as required. Alternatively, the ribozymes can be expressed from DNA/RNA vectors that are delivered to specific cells.

Synthesis of nucleic acids greater than 100 nucleotides in length is difficult using automated methods, and the therapeutic cost of such molecules is prohibitive. In this invention, small nucleic acid motifs (e.g., antisense oligonucleotides, hammerhead or the hairpin ribozymes) are used for exogenous delivery. The simple structure of these molecules increases the ability of the nucleic acid to invade targeted regions of the mRNA structure. However, these nucleic acid molecules can also be expressed within cells from eukaryotic promoters (e.g., Izant and Weintraub, 1985 *Science* 229, 345; McGarry and Lindquist, 1986 *Proc. Natl. Acad. Sci. USA* 83, 399; SullengerScanlon et al., 1991, *Proc. Natl. Acad. Sci. USA*, 88, 10591–5; Kashani-Sabet et al., 1992 *Antisense Res. Dev.*, 2,3–15; Dropulic et al., 1992 *J. Virol*, 66, 1432–41; Weerasinghe et al., 1991 *J. Virol*, 65, 5531–4; Ojwang et al., 1992 *Proc. Natl. Acad. Sci. USA* 89, 10802–6; Chen et al., 1992 *Nucleic Acids Res.*, 20, 4581–9; Sarver et al., 1990 *Science* 247, 1222–1225; Thompson et al., 1995 *Nucleic Acids Res.* 23, 2259). Those skilled in the art realize that any nucleic acid can be expressed in eukaryotic cells from the appropriate DNA/RNA vector. The activity of such nucleic acids can be augmented by their release from the primary transcript by a ribozyme (Draper et al., PCT WO93/23569, and Sullivan et al., PCT WO94/02595, both hereby incorporated in their totality by reference herein; Ohkawa et al., 1992 *Nucleic Acids Symp. Ser.*, 27, 15–6; Taira et al., 1991, *Nucleic Acids Res.*, 19, 5125–30; Ventura et al., 1993 *Nucleic Acids Res.*, 21, 3249–55; Chowrira et al., 1994 *J. Biol. Chem.* 269, 25856).

Such ribozymes are useful for the prevention of the diseases and conditions discussed above, and any other diseases or conditions that are related to the levels of EGFR activity in a cell or tissue.

By "related" is meant that the inhibition of EGFR. RNAs and thus reduction in the level respective protein activity will relieve to some extent the symptoms of the disease or condition.

Ribozymes are added directly, or can be complexed with cationic lipids, packaged within liposomes, or otherwise delivered to target cells. The nucleic acid or nucleic acid complexes can be locally administered to relevant tissues ex vivo, or in vivo through injection, infusion pump or stent, with or without their incorporation in biopolymers. In preferred embodiments, the ribozymes have binding arms which are complementary to the sequences in Tables III and IV. Examples of such ribozymes are also shown in Tables III and IV. Examples of such ribozymes consist essentially of sequences defined in these Tables.

By "consists essentially of" is meant that the active ribozyme contains an enzymatic center or core equivalent to those in the examples, and binding arms able to bind mRNA such that cleavage at the target site occurs. Other sequences may be present which do not interfere with such cleavage.

Thus, in a first aspect, the invention features ribozymes that inhibit. gene expression and/or cell proliferation via cleavage of RNA expressed from the EGFR gene. These chemically or enzymatically synthesized RNA molecules contain substrate binding domains that bind to accessible regions of their target mRNAs. The RNA molecules also contain domains that catalyze the cleavage of RNA. The RNA molecules are preferably ribozymes of the hammerhead or hairpin motif. Upon binding, the ribozymes cleave the target mRNAs, preventing translation and protein accumulation. In the absence of the expression of the target gene, cell proliferation is inhibited.

In a preferred embodiment, the enzymatic RNA molecules cleave EGFR mRNA and inhibit cell proliferation. Such ribozymes are useful for the prevention and/or treatment of cancer. Ribozymes are added directly, or can be complexed with cationic lipids, packaged within liposomes, or otherwise delivered to smooth muscle cells. The RNA or RNA complexes can be locally administered to relevant tissues through the use of a catheter, infusion pump or stent, with or without their incorporation in biopolymers. The ribozymes, similarly delivered, also are useful for inhibiting proliferation of certain cancers associated with elevated levels of the EGFR, particularly glioblastoma multiforme. Using the methods described herein, other enzymatic RNA molecules that cleave EGFR and thereby inhibit tumor cell proliferation may be derived and used as described above. Specific examples are provided below in the Tables and figures.

In another aspect of the invention, ribozymes that cleave target molecules and inhibit EGFR activity are expressed from transcription units inserted into DNA or RNA vectors. The recombinant vectors are preferably DNA plasmids or viral vectors. Ribozyme expressing viral vectors could be constructed based on, but not limited to, adeno-associated virus, retrovirus, adenovirus, or alphavirus. Preferably, the recombinant vectors capable of expressing the ribozymes are delivered as described above, and persist in target cells. Alternatively, viral vectors may be used that provide for transient expression of ribozymes. Such vectors might be repeatedly administered as necessary. Once expressed, the ribozymes cleave the target mRNA. Delivery of ribozyme expressing vectors could be systemic, such as by intravenous or intramuscular administration, by administration to target cells ex-planted from the patient followed by reintroduction into the patient, or by any other means that would allow for introduction into the desired target cell (for a review see Couture and Stinchcomb, 1996, *TIG.*, 12, 510).

By "patient" is meant an organism which is a donor or recipient of explanted cells or the cells themselves. "Patient" also refers to an organism to which enzymatic nucleic acid molecules can be administered. Preferably, a patient is a mammal or mammalian cells. More preferably, a patient is a human or human cells.

By "vectors" is meant any nucleic acid- and/or viral-based technique used to deliver a desired nucleic acid.

These ribozymes, individually, or in combination or in conjunction with other drugs, can be used to treat diseases or conditions discussed above. For example, to treat a disease or condition associated with EGFR levels, the patient may be treated, or other appropriate cells may be treated, as is evident to those skilled in the art.

In a further embodiment, the described ribozymes can be used in combination with other known treatments to treat conditions or diseases discussed above. For example, the described ribozymes could be used in combination with one or more known therapeutic agents to treat cancer.

In preferred embodiments, the ribozymes have binding arms which are complementary to the sequences in the tables III and IV (Seq ID NOs. 1–823 and 1759–1870. Examples of such ribozymes are also shown in Tables III and IV (Seq. ID Nos. 824–1758). Other sequences may be present which do not interfere with such cleavage.

Other features and advantages of the invention will be apparent from the following description of the preferred embodiments thereof, and from the claims.

DESCRIPTION OF THE PREFERRED EMBODIMENTS

The drawings will first briefly be described.

Drawings:

FIG. 1 is a diagrammatic representation of the hammerhead ribozyme domain known in the art. Stem II can be $\geq 2$ base-pair long.

FIG. 2a is a diagrammatic representation of the hammerhead ribozyme domain known in the art; FIG. 2b is a diagrammatic representation of the hammerhead ribozyme as divided by Uhlenbeck (1987, *Nature*, 327, 596–600) into a substrate and enzyme portion; FIG. 2c is a similar diagram showing the hammerhead divided by Haseloff and Gerlach (1988, *Nature*, 334, 585–591) into two portions; and FIG. 2d is a similar diagram showing the hammerhead divided by Jeffries and Symons (1989, *Nucl. Acids. Res.*, 17, 1371–1371) into two portions.

FIG. 3 is a diagrammatic representation of the general structure of a hairpin ribozyme. Helix 2 (H2) is provided with a least 4 base pairs (i.e., n is 1, 2, 3 or 4) and helix 5 can be optionally provided of length 2 or more bases (preferably 3–20 bases, i.e., m is from 1–20 or more). Helix 2 and helix 5 may be covalently linked by one or more bases (i.e., r is $\geq 1$ base). Helix 1, 4 or 5 may also be extended by 2 or more base pairs (e.g., 4–20 base pairs) to stabilize the ribozyme structure, and preferably is a protein binding site. In each instance, each N and N' independently is any normal or modified base and each dash represents a potential base-pairing interaction. These nucleotides may be modified at the sugar, base or phosphate. Complete base-pairing is not required in the helices, but is preferred. Helix 1 and 4 can be of any size (i.e., o and p is each independently from 0 to any number, e.g., 20) as long as some base-pairing is maintained. Essential bases are shown as specific bases in the structure, but those in the art will recognize that one or more may be modified chemically (abasic, base, sugar and/or phosphate modifications) or replaced with another base without significant effect. Helix 4 can be formed from two separate molecules, i.e., without a connecting loop. The connecting loop when present may be a ribonucleotide with or without modifications to its base, sugar or phosphate. "q" is $\geq 2$ bases. The connecting loop can also be replaced with a non-nucleotide linker molecule. H refers to bases A, U, or C. Y refers to pyrimidine bases. "'" refers to a covalent bond.

FIG. 4 is a representation of the general structure of the hepatitis delta virus ribozyme domain known in the art.

FIG. 5 is a representation of the general structure of the self-cleaving VS RNA ribozyme domain.

Figure 6C:
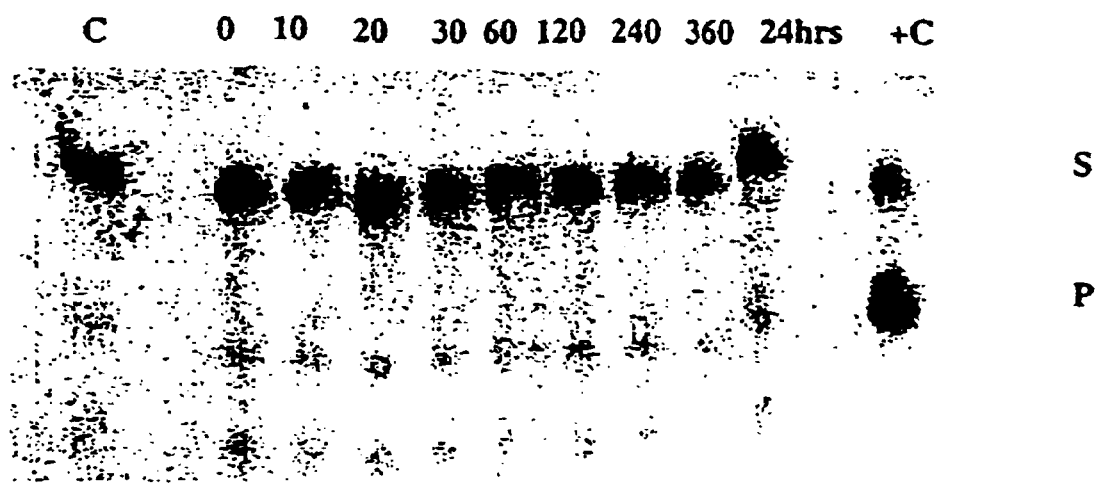

FIG. 6 shows in vitro RNA cleavage activity of Amino ribozymes tergeted against EGFR RNA. a Autoradiograph of the cleavage reaction. The reaction was performed in the presence of 50 mM Tris.HCl (pH 7.5), 10 mM $MgCl_2$ at 37° C. as described below. Times of the reaction in minutes are given above the lanes. S0 represents intact substrate in Tris.CHl buffer without the addition of ribozyme at time 0. S1 represents intact substrate in Tris.CHl buffer at time 60 min. +C represents a positive control of cleaved product only. Band S represents intact substrate, band P cleaved product and band D degradation; b Time course of cleavage. Bands from autoradiography were quantified by scanning densitometry and the fraction of substrate remaining plotted against time. inset. Semilog plots were used to determine the half life of the substrate ($t_{1/2}$=0.693/k); c Autoradiograph showing reaction of the EGFR ribozyme against a non complementary substrate RNA. 40 nM ribozyme was added to 1 nM substrate in the presence of 50 mM Tris.CHl (pH 7.5), 10 mM $MgCl_2$ at 37° C. Band S refers to intact substrate and band P is cleaved product. Reaction times are given in minutes (unless stated otherwise). C represents intact substrate without the addition of ribozyme. +C represents cleaved product.

Figure 7C:
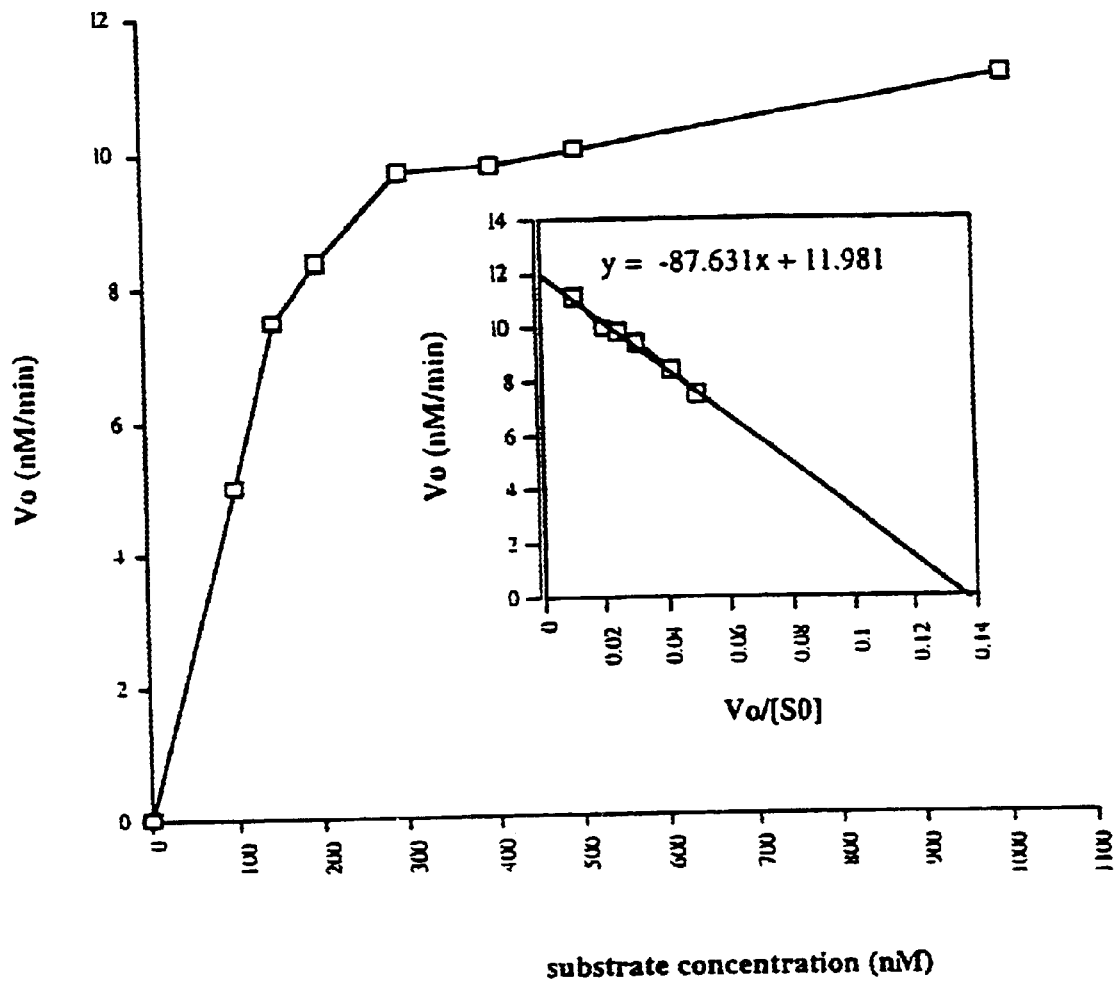

FIG. 7 Representative examples of autoradiographs depicting the time course of cleavage reactions exhibited by EGFR ribozyme against it's target substrate under multiple turnover reactions. a In vitro activity of 10 nM ribozyme with 300 nM of 5' [32P] labelled substrate RNA; b In vitro activity of 10 nM ribozyme with 1 $\mu$M of 5'[32P] labelled substrate RNA. Reactions were performed in the presence of 50 mM Tris.CHl (pH 7.5), 10 mM $MgCl_2$ at 37° C. as described below. Reaction times, in minutes, are given above the lanes. C represents intact substrate in Tris.CHl buffer without the addition of ribozyme. Band S refers to intact substrate and band P refers to cleaved product. c Kinetics of hammerhead cleavage reactions exhibited by the. EGFR ribozyme. The initial rate of reaction (Vo,nM/min) is plotted versus substrate concentration. Ribozyme concentration was 10 nM while substrate concentration varied as indicated. inset Eadie-Hofstee plot of this data.

FIG. 8 shows a generic structure of chemically modified amino hammerhead ribozyme.

FIG. 9 shows a generic structure of chemically modified C-allyl hammerhead ribozyme.

TARGET SITES

Targets for useful ribozymes can be determined as disclosed in Draper et al., WO 93/23569; Sullivan et al., WO 93/23057; Thompson et al., WO 94/02595; Draper et al., WO 95/04818; McSwiggen et al., U.S. Pat. No. 5,525,468 and hereby incorporated by reference herein in totality. Rather than repeat the guidance provided in those documents here, below are provided specific examples of such methods, not limiting to those in the art. Ribozymes to such targets are designed as described in those applications and synthesized to be tested in vitro and in vivo, as also described. Such ribozymes can also be optimized and delivered as described therein.

The sequence of human EGFR RNAs were screened for optimal ribozyme target sites using a computer folding algorithm. Hammerhead or hairpin ribozyme cleavage sites were identified. These sites are shown in Tables III and IV (All sequences are 5' to 3' in the tables) The nucleotide base position is noted in the Tables as that site to be cleaved by the designated type of ribozyme. The nucleotide base position is noted in the Tables as that site to be cleaved by the designated type of ribozyme.

Hammerhead or hairpin ribozymes were designed that could bind and were individually analyzed by computer folding (Jaeger et al., 1989 *Proc. Natl. Acad. Sci. USA*, 86, 7706) to assess whether the ribozyme sequences fold into the appropriate secondary structure. Those ribozymes with unfavorable intramolecular interactions between the binding arms and the catalytic core are eliminated from consideration. Varying binding arm lengths can be chosen to optimize activity. Generally, at least 5 bases on each arm are able to bind to, or otherwise interact with, the target RNA.

Ribozymes of the hammerhead or hairpin motif were designed to anneal to various sites in the mRNA message. The binding arms are complementary to the target site sequences described above. The ribozymes were chemically synthesized. The method of synthesis used follows the procedure for normal RNA synthesis as described in Usman et al., 1987 *J. Am. Chem. Soc.*, 109, 7845; Scaringe et al., 1990 *Nucleic Acids Res.*, 18, 5433; and Wincott et al., 1995 *Nucleic Acids Res.* 23, 2677–2684 and makes use of common nucleic acid protecting and coupling groups, such as dimethoxytrityl at the 5'-end, and phosphoramidites at the 3'-end. Small scale synthesis were conducted on a 394 Applied Biosystems, Inc. synthesizer using a modified 2.5 $\mu$mol scale protocol with a 5 min coupling step for alkylsilyl protected nucleotides and 2.5 min coupling step for 2'-O-methylated nucleotides. Table II outlines the amounts, and the contact times, of the reagents used in the synthesis cycle. A 6.5-fold excess (163 $\mu$L of 0.1 M=16.3 $\mu$mol) of phosphoramidite and a 24-fold excess of S-ethyl tetrazole (238

μL of 0.25 M=59.5 μmol) relative to polymer-bound 5'-hydroxyl was used in each coupling cycle. Average coupling yields on the 394 Applied Biosystems, Inc. synthesizer, determined by calorimetric quantitation of the trityl fractions, were 97.5–99%. Other oligonucleotide synthesis reagents for the 394 Applied Biosystems, Inc. synthesizer:detritylation solution was 2% TCA in methylene chloride (ABI); capping was performed with 16% N-methyl imidazole in THF (ABI) and 10% acetic anhydride/10% 2,6-lutidine in THF (ABI); oxidation solution was 16.9 mM $I_2$, 49 mM pyridine, 9% water in THF (Millipore). B & J Synthesis Grade acetonitrile was used directly from the reagent bottle. S-Ethyl tetrazole solution (0.25 M in acetonitrile) was made up from the solid obtained from American International Chemical, Inc.

Deprotection of the RNA was performed as follows. The polymer-bound oligoribonucleotide, trityl-off, was transferred from the synthesis column to a 4 mL glass screw top vial and suspended in a solution of methylamine (MA) at 65° C. for 10 min. After cooling to −20° C., the supernatant was removed from the polymer support. The support was washed three times with 1.0 mL of $EtOH:MeCN:H_2O/3:1:1$, vortexed and the supernatant was then added to the first supernatant. The combined supernatant, containing the oligoribonucleotide, were dried to a white powder.

The base-deprotected oligoribonucleotide was resuspended in anhydrous TEA.HF/NMP solution (250 μL of a solution of 1.5 mL N-methyl-pyrrolidinone, 750 μL TEA and 1.0 mL TEA.3HF to provide a 1.4M HF concentration) and heated to 65° C. for 1.5 h. The resulting, fully deprotected, oligomer was quenched with 50 mM TEAB (9 mL) prior to anion exchange desalting.

For anion exchange desalting of the deprotected oligomer, the TEAB solution was loaded onto a Qiagen 500® anion exchange cartridge (Qiagen Inc.) that was prewashed with 50 mM TEAB (10 mL). After washing the loaded cartridge with 50 mM TEAB (10 mL), the RNA was eluted with 2 M TEAB (10 mL) and dried down to a white powder.

Inactive hammerhead ribozymes were synthesized by substituting a U for $G_5$ and a U for $A_{14}$ (numbering from Hertel, K. J., et al., 1992, *Nucleic Acids Resp.*, 20, 3252).

The average stepwise coupling yields were >98% (Wincott et al., 1995 *Nucleic Acids Res.* 23, 2677–2684).

Hairpin ribozymes are synthesized in two parts and annealed to reconstruct the active ribozyme (Chowrira and Burke, 1992 *Nucleic Acids Res.*, 20, 2835–2840). Ribozymes are also synthesized from DNA templates using bacteriophage T7 RNA polymerase (Milligan and Uhlenbeck, 1989, *Methods Enzymol.* 180, 51).

Ribozymes are modified to enhance stability and/or enhance catalytic activity by modification with nuclease resistant groups, for example, 2'-amino, 2'-C-allyl, 2'-flouro, 2'-O-methyl, 2'-H, nucleotide base modifications (for a review see Usman and Cedergren, 1992 *TIBS* 17, 34; Usman et al., 1994 *Nucleic Acids Symp. Ser.* 31,163; Burgin et al., 1996 *Biochemistry* 6, 14090). Ribozymes are purified by gel electrophoresis using general methods or are purified by high pressure liquid chromatography (HPLC; See Wincott et al., supra) the totality of which is hereby incorporated herein by reference) and are resuspended in water.

The sequences of the ribozymes that are chemically synthesized, useful in this study, are shown in Tables III–IV. Those in the art will recognize that these sequences are representative only of many more such sequences where the enzymatic portion of the ribozyme (all but the binding arms) is altered to affect activity. For example, stem-loop II sequence of hammerhead ribozymes can be altered (substitution, deletion, and/or insertion) to contain any sequences provided a minimum of two base-paired stem structure can form. Similarly, stem-loop IV sequence of hairpin ribozymes listed in Tables IV (5'-CACGUUGUG-3') can be altered (substitution, deletion, and/or insertion) to contain any sequence, provided a minimum of two base-paired stem structure can form. Preferably, no more than 200 bases are inserted at these locations. The sequences listed in Tables III and IV may be formed of ribonucleotides or other nucleotides or non-nucleotides. Such ribozymes (which have enzymatic activity) are equivalent to the ribozymes described specifically in the Tables.

Optimizing Ribozyme Activity

Ribozyme activity can be optimized as described by Draper et al., supra. The details will not be repeated here, but include altering the length of the ribozyme binding arms (stems I and II, see FIG. 2c), or chemically synthesizing ribozymes with modifications (base, sugar and/or phosphate) that prevent their degradation by serum ribonucleases and/or enhance their enzymatic activity (see e.g., Eckstein et al., International Publication No. WO 92/07065; Perrault et al., 1990 *Nature* 344, 565; Pieken et al., 1991 *Science* 253, 314; Usman and Cedergren, 1992 *Trends in Biochem. Sci.* 17, 334; Usman et al., International Publication No. WO 93/15187; and Rossi et al., International Publication No. WO 91/03162; Sproat, U.S. Pat. No. 5,334,711; and Burgin et al., supra; all of these describe various chemical modifications that can be made to the base, phosphate and/or sugar moieties of enzymatic RNA molecules). Modifications which enhance their efficacy in cells, and removal of stem II bases to shorten RNA synthesis times and reduce chemical requirements are desired. (All these publications are hereby incorporated by reference herein.).

By "enhanced enzymatic activity" is meant to include activity measured in cells and/or in vivo where the activity is a reflection of both catalytic activity and ribozyme stability. In this invention, the product of these properties in increased or not significantly (less that 10 fold) decreased in vivo compared to an all RNA ribozyme.

The enzymatic nucleic acid having chemical modifications which maintain or enhance enzymatic activity is provided. Such nucleic acid is also generally more resistant to nucleases than unmodified nucleic acid. By "modified bases" in this aspect is meant nucleotide bases other than adenine, guanine, cytosine and uracil at 1' position or their equivalents; such bases may be used within the catalytic core of the enzyme as well as in the substrate-binding regions. In particular, the invention features modified ribozymes having a base substitution selected from pyridin-4-one, pyridin-2-one, phenyl, pseudouracil, 2, 4, 6-trimethoxy benzene, 3-methyluracil, dihydrouracil, naphthyl, 6-methyl-uracil and aminophenyl. As noted above, substitution in the core may decrease in vitro activity but enhances stability. Thus, in a cell and/or in vivo the activity may not be significantly lowered. As exemplified herein such ribozymes are useful in a cell and/or in vivo even if activity over all is reduced 10 fold. Such ribozymes herein are said to "maintain" the enzymatic activity on all RNA ribozyme.

Sullivan, et al., supra, describes the general methods for delivery of enzymatic RNA molecules. Ribozymes may be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, ribozymes may be directly delivered ex vivo to cells or tissues with or without the aforementioned vehicles. Alternatively, the RNA/vehicle combination is locally delivered by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of ribozyme delivery and administration are provided in Sullivan et al., supra and Draper et al., supra which have been incorporated by reference herein.

Another means of accumulating high concentrations of a ribozyme(s) within cells is to incorporate the ribozyme-encoding sequences into a DNA or RNA expression vector. Transcription of the ribozyme sequences are driven from a promoter for eukaryotic RNA polymerase I (pol I), RNA polymerase II (pol II), or RNA polymerase III (pol III). Transcripts from pol II or pol III promoters will be expressed at high levels in all cells; the levels of a given pol II promoter in a given cell type will depend on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990 *Proc. Natl. Acad. Sci. USA*, 87, 6743–7; Gao and Huang 1993 *Nucleic Acids Res.*, 21, 2867–72; Lieber et al., 1993 *Methods Enzymol.*, 217, 47–66; Zhou et al., 1990 *Mol. Cell. Biol.*, 10, 4529–37). Several investigators have demonstrated that ribozymes expressed from such promoters can function in mammalian cells (e.g. Kashani-Sabet et al., 1992 *Antisense Res. Dev.*, 2, 3–15; Ojwang et al., 1992 *Proc. Natl. Acad. Sci. USA*, 89, 10802–6; Chen et al., 1992 *Nucleic Acids Res.*, 20, 4581–9; Yu et al., 1993 *Proc. Natl. Acad. Sci. USA*, 90, 6340–4; L'Huillier et al., 1992 *EMBO J.* 11, 4411–8; Lisziewicz et al., 1993 *Proc. Natl. Acad. Sci. U.S.A.*, 90, 8000–4; Thompson et al., 1995 *Nucleic Acids Res.* 23, 2259; Sullenger & Cech, 1993, *Science*, 262, 1566). The above ribozyme transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors) (for a review see Couture and Stinchcomb, 1996, supra).

In a preferred embodiment of the invention, a transcription unit expressing a ribozyme that cleaves mRNAs encoded by EGFR is inserted into a plasmid DNA vector or an adenovirus or adeno-associated virus DNA viral vector or a retroviral RNA vector. Viral vectors have been used to transfer genes and lead to either transient or long term gene expression (Zabner et al., 1993 *Cell* 75, 207; Carter, 1992 *Curr. Opi. Biotech.* 3, 533). The adenovirus vector is delivered as recombinant adenoviral particles. The DNA may be delivered alone or complexed with vehicles (as described for RNA above). The recombinant adenovirus or AAV particles are locally administered to the site of treatment, e.g., through incubation or inhalation in vivo or by direct application to cells or tissues ex vivo. Retroviral vectors have also been used to express ribozymes in mammalian cells (Ojwang et al., 1992 supra; Thompson et al., 1995 supra; Couture and Stinchcomb, 1996, supra).

In another preferred embodiment, the ribozyme is administered to the site of EGFR expression (e.g., tumor cells) in an appropriate liposomal vesicle.

EXAMPLES

Example 1

Identification of Potential Ribozyme Cleavage Sites in Human EGFR RNA

The sequence of human EGFR RNA was screened for accessible sites using a computer folding algorithm. Regions of the mRNA that did not form secondary folding structures and potential hammerhead and/or hairpin ribozyme cleavage sites were identified. The sequences of these cleavage sites are shown in tables III and IV.

Example 2

Selection of Ribozyme Cleavage Sites in Human EGFR RNA

To test whether the sites predicted by the computer-based RNA folding algorithm corresponded to accessible sites in EGFR RNA, 20 hammerhead sites were selected for analysis. Ribozyme target sites were chosen by analyzing genomic sequences of human EGFR (GenBank Accession No. X00588) and prioritizing the sites on the basis of folding. Hammerhead ribozymes were designed that could bind each target (see FIG. 2C) and were individually analyzed by computer folding (Christoffersen et al., 1994 *J. Mol. Struc. Theochem*, 311, 273; Jaeger et al., 1989, *Proc. Natl. Acad. Sci. USA*, 86, 7706) to assess whether the ribozyme sequences fold into the appropriate secondary structure. Those ribozymes with unfavorable intramolecular interactions between the binding arms and the catalytic core were eliminated from consideration. As noted below, varying binding arm lengths can be chosen to optimize activity. Generally, at least 5 bases on each arm are able to bind to, or otherwise interact with, the target RNA.

Example 3

Chemical Synthesis and Purification of Ribozymes for Efficient Cleavage of EGFR RNA Ribozymes of the hammerhead or hairpin motif were designed to anneal to various sites in the RNA message. The binding arms are complementary to the target site sequences described above. The ribozymes were chemically synthesized. The method of synthesis used followed the procedure for normal RNA synthesis as described in Usman et al., (1987 *J. Am. Chem. Soc.*, 109, 7845), Scaringe et al., (1990 *Nucleic Acids Res.*, 18, 5433) and Wincott et al., supra, and made use of common nucleic acid protecting and coupling groups, such as dimethoxytrityl at the 5'-end, and phosphoramidites at the 3'-end. The average stepwise coupling yields were >98%. Inactive ribozymes were synthesized by substituting a U for $G_5$ and a U for $A_{14}$ (numbering from Hertel et al., 1992 *Nucleic Acids Res.*, 20, 3252). Hairpin ribozymes were synthesized in two parts and annealed to reconstruct the active ribozyme (Chowrira and Burke, 1992 *Nucleic Acids Res.*, 20, 2835–2840). Ribozymes were also synthesized from DNA templates using bacteriophage T7 RNA polymerase (Milligan and Uhlenbeck, 1989, *Methods Enzymol.* 180, 51). All ribozymes were modified to enhance stability by modification with nuclease resistant groups, for example, 2'-amino, 2'-C-allyl, 2'-flouro, 2'-O-methyl, 2'-H (for a review see Usman and Cedergren, 1992 *TIBS* 17, 34). Ribozymes were purified by gel electrophoresis using general methods or were purified by high pressure liquid chromatography (HPLC; See Wincott et al., supra; the totality of which is hereby incorporated herein by reference) and were resuspended in water. The sequences of the chemically synthesized ribozymes used in this study are shown below in Table III and IV.

Example 4

Ribozyme Cleavage of EGFR RNA Target

Twenty hammerhead-type ribozymes targeted to the human EGFR RNA were designed and synthesized to test the cleavage activity in vitro. The target sequences and the nucleotide location within the EGFR mRNA are given in Table III. All hammerhead ribozymes were synthesized with binding arm (Stems I and III; see FIG. 2C) lengths of seven nucleotides. The relative abilities of a HH ribozyme to cleave human EGFR RNA is summarized in FIG. 6 and 7.

Full-length or partially full-length, internally-labeled target RNA for ribozyme cleavage assay was prepared by in vitro transcription in the presence of $[\alpha^{-32}P]$ CTP, passed over a G 50 Sephadex column by spin chromatography and used as substrate RNA without further purification. Alternately, substrates were 5'-$^{32}$P-end labeled using T4 polynucleotide kinase enzyme. Assays were performed by pre-warming a 2×concentration of purified ribozyme in ribozyme cleavage buffer (50 mM Tris-CHl, pH 7.5 at 37° C., 10 mM $MgCl_2$) and the cleavage reaction was initiated by adding the 2×ribozyme mix to an equal volume of substrate RNA (maximum of 1–5 nM) that was also pre-warmed in cleavage buffer. As an initial screen, assays were carried out for 1 hour at 37° C. using a final concentration of either 40 nM or 1 $\mu$M ribozyme, i.e., ribozyme excess. The reaction was quenched by the addition of an equal volume of 95% formamide, 20 mM EDTA, 0.05% bromophenol blue and 0.05% xylene cyanol after which the sample was heated to 95° C. for 2 minutes, quick chilled and loaded onto a denaturing polyacrylamide gel. Substrate RNA and the specific RNA cleavage products generated by ribozyme cleavage were visualized on an autoradiograph of the gel. The percentage of cleavage was determined by Phosphor Imager® quantitation of bands representing the intact substrate and the cleavage products.

Single Turnover Reaction: Alternately, Cleavage reactions were carried out in 50 mM Tris.CHl, pH 7.5 and 10 mM $MgCl_2$ at 37° C. In order to disrupt aggregates that can form during storage, unlabelled ribozyme and 5'end labelled substrate were denatured and renatured separately in standard cleavage buffer (50 mM Tris.HCl, pH 7.5 ) by heating to 90° C. for 2 minutes and allowed to equilibrate to the reaction temperature of 37° C. for 15 minutes. Each RNA solution was then adjusted to a final concentration of 10 mM $MgCl_2$ and incubated at 37° C. for a further 15 minutes. Cleavage reactions were initiated by combining the ribozyme and the substrate samples to the required concentrations in a final volume of 100 $\mu$l. Ribozyme concentration was 40 nM and substrate concentration was 1 nM. The reaction was also repeated using double (2 nM) and half (0.5 nM) the concentration of substrate to verify that the reaction was indeed performed under single turnover conditions. Aliquots of 10 $\mu$l were removed at appropriate time intervals between 0 and 120 minutes and quenched by adding an equal volume of formamide loading buffer (9:1 (v:v) formamide:1×TBE) and frozen on dry ice. Product and substrate were separated by denaturing 20% polyacrylamide (7M urea) gel electrophoresis. To determine the fraction of cleavage, substrate and product bands were located by autoradiography of wet gels and quantified by densitometry of these autoradiograms. Autorads were scanned using an AGFA focus scanner connected to a Macintosh computer and images were saved as TIFF files. The programme NIH Image 1.58 (Division of Computing and Research Technology, NIH, Bethesda, USA) was used to plot and quantify the band intensities. In addition, the relevant bands were excised from the gel and quantified by scintillation counting of the slices cut from the gel (Packard Tricarb 2000 CA liquid scintillation analyser).

Reaction rate constants (k) were obtained from the slope of semilogarithmic plots of the amount of substrate remaining versus time. The activity half time t1/2 was calculated as 0.693/k. Each rate constant was determined from duplicate experiments.

In order to show the specificity of cleavage demonstrated under the above conditions, the experiment was repeated using a different substrate, relating to another site along the human EGFR mRNA. All conditions remained as described above except samples were taken over a longer time period i.e.at intervals spanning over 24 hours rather than over 2 hours.

Multiple Turnover Reactions: The kinetic characteristics of ribozyme RPI.4782 were determined from Eadie—Hofstee plots obtained from initial velocities with multiple turnovers done with 5' 32P labelled substrate. Cleavage reactions were carried out in 50 mM Tris.CHl, pH7.5 and 10 mM $MgCl_2$ at 37° C. Stock solutions of 100 nM ribozyme and 500 nM–2 uM substrate RNA were prepared in 50 mM Tris.CHl, pH 7.5, preheated seperately at 90° C. for 2 minutes and cooled to 37° C. for 15 minutes. After $MgCl_2$ was added to each of these solutions to a final volume of 10 mM, a further incubation period of 15 minutes at 37° C. took place. Cleavage reactions were performed in a final volume of 100$\mu$l with a concentration of 10 nM ribozyme and concentrations of substrate between 100 nM and 1 $\mu$M. Reactions were initiated by the addition of ribozyme stock solution to substrate. Aliquots of 10 $\mu$l were taken at time intervals between 0 and 120 minutes, quenched by adding an equal volume of formamide loading buffer and frozen on dry ice. Intact substrate and products of cleavage were separated by electrophoresis on a 20% polyacrylamide/7M urea denaturing gel and were detected by autoradiography. The degree of cleavage at each time point was quantified by scanning densitometry of the resulting autoradiogram. Initial rates of reaction were measured at eight substrate concentrations and values of Kcat and Km were determined using Eadie-Hofstee plots.

As shown in FIG. 6 and 7, Amino hammerhead ribozymes (RPI.4782) targeted against EGFR RNA cleaved their target RNAs in a sequence-specific manner the cleavage rates appeared to follow saturation kinetics with respect to concentration of substrate. Cleavage rates were first order at low substrate concentrations, however, as the concentration of substrate increased, the reaction rates levelled off suggesting that ribozymes were effectively saturated with substrate. These results indicate that the cleavage reactions were truly catalytic and were therefore amenable to analysis using Michaelis Menten rate equation. From a Eadie-Hofstee plot the kinetic parameters Km and Kcat were determined; ribozyme exhibited a Km value of 87 nM and a Kcat value of 1.2 $min^{-1}$.

Under single turnover conditions, ribozyme RPI.4782 exhibited rapid cleavage of it's target sequence, the half life of the substrate being only 7 minutes. The high activity of this ribozyme is in agreement with the findings of Beigelman et al. (1995c). They reported that a ribozyme modified in the same manner as RPI.4782 exhibited almost wild type activity, with the half life of the substrate being only 3 minutes. Although cleavage was slightly slower than that demonstrated by Beigelman et al. (1995c), these findings clearly demonstrate that ribozyme RPI.4782 is able to cleave it's target in a highly efficient manner.

When the experiment was repeated using a different, non complementary, substrate sequence, no cleavage products were evident (FIG. 3.3), demonstrating the sequence specificity of this molecule.

To assess more precisely the activity of ribozyme Amino ribozyme (RPI.4782), the kinetic parameters $K_M$ and $k_{cat}$ were determined under multiple turnover conditions. The results indicate that the cleavage reaction was truly catalytic with a turnover rate ($K_{cat}$) of 1.2 min$^{-1}$ and a $K_M$ value of 87 nM (FIG. 6 and 7). These results fall in line with typical values reported for the hammerhead ribozyme of 1–2 min$^{-1}$ and 20–200 nM for Kcat and Km respectively (Kumar et al, 1996). Direct comparisons are difficult, however, since many factors including base sequence, length of substrate binding arms and varying chemical modifications can have an effect on these kinetic parameters (Fedor & Uhlenbeck, 1992).

Example 5

Stability of EGFR Ribozymes in Fetal Calf Serum

To assess the stability of the chemically modified ribozyme, a comparative stability study was carried out in 100% foetal calf serum (Gibco, Paisley, U.K.) at 37° C. Degradation profiles of 5' and internally [$^{32}$P] labelled ribozyme were compared to those of 5'-end [$^{32}$P] labelled phosphoodiester (PO), phosphorothioate (PS) oligodeoxynucleotides and unmodified RNA.

Synthesis/labelling: 37 mer PO and PS oligonucleotides were synthesized on an automated DNA synthesizer (model 392, Applied Biosystems, Warrington, U.K.) using standard phosphoramide chemistry (section 2.2.1). The chemically modified 37 mer ribozyme (Amino Hammerhead Ribozyme; FIG. 8) and the 15 mer unmodified all RNA substrate were synthesized as described above. Ribozymes and oligonucleotides were radiolabelled with [$^{32}$P] ATP and purified on 20% polyacrylamide gel as previously described.

Degradation study conditions: Radiolabelled ribozymes/oligonucleotides were incubated in 100 μl of FCS at 37° C. to give a final concentration of 200 nM. 10 μl aliquots were removed at timed intervals, mixed with a loading buffer containing 80% formamide, 10 mM EDTA (pH8.0), 0.25% xylene cyanol, 0.25% bromophenol blue, and frozen at -20 C prior to gel loading. Degradation profiles were analysed by 20% polyacrylamide (7M urea) gel electrophoresis and autoradiography.

A comparative stability study was undertaken in 100% fetal calf serum (FCS) to compare the degradation profiles of 5' end labelled and internally labelled amino ribozyme to those of 5'end labelled unmodified RNA substrate, phosphodiester (PO) and phosphorothioate (PS) oligodeoxynucleotides. The chemical modifications of the amino ribozyme resulted in a substantial increase in nuclease resistance over that of the unmodified substrate. The half life ($t_{50\%}$) of the internally labelled ribozyme was approximately 20 hours whereas the substrate was completely degraded within the time that it took to add the RNA to serum, mix and quench the reaction ($t_{50\%}$<1 min). It was interesting to note that although the patterns of degradation were clearly different for the internally labelled ribozyme (FIG. 3.6a) and the 5'end labelled ribozyme, the kinetics of degradation were strikingly similar. ($t_{50\%}$ of ≈20 hours for both).

A comparison of ribozyme degradation and oligodeoxynucleotide degradation was also performed. The chemically modified ribozyme appeared to be more stable in FCS than either the PO oligonucleotide or the PS oligonucleotide; the approximate half lives being 10 minutes and 5 hours respectively. It must be noted, however, that the apparent degradation products migrated to the position of free phosphate. This suggests that dephosphorylation (removal of [$^{32}$P] label) occurred, resulting in a progressive increase in free phosphate concentration with time.

There is no doubt, however, that the findings of this study show that the chemical modifications applied to ribozyme result in an extremely stable structure. Under the conditions of this experiment amino ribozyme proved to be the most stable to nuclease mediated degradation in fetal calf serum.

Example 6

Ribozymes Uptake Studies

Cell Culture Techniques U87-MG cell line was purchased from the European Cell Culture Collection, Porton Down, U.K. These human glioblastoma astrocytoma cells were originally derived from a grade 3 malignant glioma by explant technique (Poten et al.,1968). A431 cells were derived from a vulval carcinoma and expresses the EGFR at levels 10 to 50 fold higher than seen in other cell lines (Ullrich et al., 1984).

The cell lines U87-MG and Raw 264.7 were maintained in Dulbecco's modified Eagle's media (DMEM) supplemented by 10% v/v foetal bovine serum (FBS), 1% penicillin/streptomycin and 1% v/v L-glutamine (all supplied from Gibco, Paisley, U.K.). The same media, without the addition of the foetal bovine serum, was used in the stability and uptake studies. A431 cells were maintained under the same conditions except glutamine was added to a final concentration of 2% v/v. CaCo-2 cells were kindly cultured and plated by Vanessa Moore in DMEM, 10% FBS, 1% non essential amino acids, 1% peniciilin/ streptomycin, and 1% L-glutamine.

Cells were cultured in 75cm$^3$ plastic tissue culture flasks (Falcon, U.K.) with 25 ml of the respective media. The cultures were incubated at 37° C. in a humidified (95%) atmosphere of 5% CO2 in air. Stock cultures were maintained by changing the media every 48 hours and passaged (1:5) when confluent (after approximately 4 days). Passaging was carried out using the following procedure:

The media was removed and the cells washed with 10 ml of phosphate-buffered saline solution (PBS). Following this, 5 ml of 2×Trypsin/EDTA (0.25% w/v trypsin, 0.2% disodium ethylenediamine tetraacetate in PBS, pH 7.2) was added and the flasks incubated at 37° C. for 5 minutes. The flasks were tapped to dislodge the cell monolayer from the bottom and fresh media was added to neutralise the trypsin. The cells were split as required and media added to a final volume of 25 ml.

For long term storage, frozen stock cultures were prepared in the following manner:

Stock cultures were trypsinised as described and neutralised with the addition of 10 ml of DMEM media. The cell suspension was then transferred to a 15 ml universal tube (Falcon, U.K.) and centrifuged for 3 minutes at 350 revolutions per minutes. The supernatant was decanted and the cell pellet was resuspnded in 1 ml of freezing media (10% DMSO, 90% heat inactivated foetal calf serum) and transferred to a 2 ml screw capped cryovial (Costar, U.K.). The ampule was then placed in the freezing head of a liquid nitrogen freezer for 4–6 hours before being transferred into liquid nitrogen (−196° C.) cell bank. When required, the cells were recovered by rapid thawing at 37° C. and gradual dilution with DMEM media before seeding in 25 cm³ flasks (Falcon, U.K.).

The viable cell density of stock cultures was measured by haemocytometry using a trypan blue exclusion test. 100 μl of trypan blue (4 mg ml$^{-1}$) was mixed with 400 μl of cell suspension (1:1.25 dilution). A small amount of the trypan blue-cell suspension was transfered to the counting chamber of a Neubauer haemocytometer, with depth of 0.1 mm and area 1/400 mm² (Weber Scientific International Ltd, U.K.). The cells were counted in the 5 large squares of the haemocytometer using a light microscope. Since live cells do not take up the trypan blue dye, while dead cells do, the number of viable (unstained) cells were counted. The cell density was calculated using the following equation:

cells ml$^{-1}$=average count per square×10$^4$×1.25(dilution factor of trypan blue)

Cell Association Studies: A series of experiments were conducted to examine the mechanism of uptake of the ribozyme in the U87-MG glioblastoma cell line. The following general experimental procedure was used throughout these studies unless otherwise stated.

Synthesis/labelling: Prior to use in uptake studies, the 37 mer ribozyme was internally labelled with 32P as previously described (section 2.3.2) and purified by 20% native polyacrylamaide gel electrophoresis. [14C] Mannitol (specific activity 56 mCi/mmol) was purchased from Amersham (Amersham, U.K.).

Uptake study procedure: U87-MG cells were cultured on plastic 24-well plates (Falcon, U.K.). Confluent stock cultures were trypsinised and the cell density of the stock suspension diluted to 0.5×10$^5$ cells ml$^{-1}$ with DMEM media. Each well was seeded with 2 ml of the diluted cell suspension to give a final concentration of 1×10$^5$ well-1. The plates were incubated at 37° C. in a humidified (95%) atmosphere of 5% $CO_2$ in air. After approximately 20–24 hours, the cell monolayers had reached confluency and were then ready for uptake experiments. The media was then removed and the monolayer carefully washed twice with PBS (2×1 ml×5 min) to remove any traces of serum. The washing solution was aspirated and replaced with 200 μl of serum free DMEM media containing the radiolabelled ribozyme. Both PBS and serum free media were equilibrated at 37° C. for 1 hour prior to use. The plates were incubated at 37° C., unless otherwise stated, in a dry environment for the duration of the experiment. Once incubated for the desired period of time, the apical media was carefully collected and their radioactive content assessed by liquid scintillation counting (LSC) The cells were then washed 3 times*(3×0.5 ml×5 min) with ice cold PBS/sodium azide (0.05% w/v NaN$_3$/PBS) to inhibit any further cellular metabolism and remove any ribozyme loosley associated with the cell surface. The washings were collected and their radioactive content determined by LSC. Cell monolayers were solubilised by shaking with 0.5 ml of 3% v/v Triton X100 (Aldrich Chemical Company, Gillingham, UK) in distilled water for 1 hour at room temperature. The wells were washed twice more (2×0.5 ml) with Triton X-100 to ensure that all the cells had been harvested and the radioactivity content of the cellular fraction determined by LSC. Unless otherwise indicated, all experiments were performed at a final concentration of 0.01 μM 32P internally labelled riboxyme and incubated for a period of 60 minutes.

The uptake of Amino ribozymes were compared in different cell lines. The results show that cellular association of these ribozymes ranged from 0.325±0.021 ng/10$^5$ cells in intestinal epithelial cells to 1.09±0.207 ng/10$^5$ cells in the macrophage cell line.

The ability of ribozymes to penetrate the cell membrane and the mechanism of entrance are important considerations in developing ribozymes as therapeutics. The mechanisms by which oligodeoxynucleotides enter cells has been well documented (for review see Akhtar & Juliano, 1991) and include the involvement of fluid phase, adsorptive and receptor mediated endocytosis. The mechanism and extent of uptake is dependent on many factors including oligonucleotide type and length and cell line studied. In contrast, however, no mechanism of cellular uptake has yet been described for ribozymes and ribonucleotides. In order to investigate the means of uptake of ribozyme RPI.4782 in glioma cells, a series of cellular association studies were performed in the human glioma derived cell line, U87-MG.

The cellular association of ribozyme RPI.4782 to U87-MG cells appeared to be biphasic, with a rapid initial phase continuing for approximately two hours followed by a slower second phase. The cellular association of oligonucleotides has been shown to be a dynamic process Drepresenting both uptake and efflux processes (Jaroszewski & Cohen, 1990). Consequently, the plateauing seen in the second phase could represent an equilibrium of both uptake and exocytosis of ribozyme. The uptake of ribozyme RPI.4782 was strongly dependent on temperature, suggesting that an active process is involved. In addition, the metabolic inhibitors, sodium azide and 2-deoxyglucose significantly inhibited cellular association by 66%, demonstrating that ribozyme uptake was also energy dependent.

The energy and temperature dependency of cellular association of this ribozyme in U87-MG cells are characteristic of an active process, indicating that the mechanism of uptake is via endocytosis. These findings do not, however, distinguish whether fluid phase endocytosis or receptor mediated endocytosis is involved; since both mechanisms will be effected by these parameters (Beltinger et al., 1994). In order to evaluate the pathway of internalization, the uptake of a fluid phase marker, [14C] mannitol, was measured to determine the extent of pinocytosis in U87-MG cells. The basal rate of pinocytosis in these cells remained extremely low throughout the time period tested and it is unlikely, therefore, to account for a significant fraction of ribozyme uptake in this cell line.

To investigate whether ribozyme RPI.4782 is taken up into U87-MG cells by receptor mediated endocytosis a self competition study was conducted. Ribozyme uptake was found to be significantly inhibited by competition with unlabelled ribozyme. This demonstrates that cellular association was concentration dependent and suggests that the dominant uptake mechanism is via receptor mediated endocytosis.

Receptor mediated endocytosis involves the internalization of molecules via specific membrane protein, cell surface receptors. Consequently, a proteolytic enzyme such as trypsin or pronase® can be used to determine the extent to which membrane proteins mediate uptake (Beck et al., 1996; Shoji et al., 1991; Wu-pong et al., 1994). In a study investigating the cellular association of oligonucleotides in intestinal CaCo-2 cells, Beck et al. (1996) reported a 50% reduction of uptake upon cell surface washing with pronase, while 60% of oligonucleotide uptake was reported to be trypsin sensitive in Rauscher Red 5-1.5 ertythroleukemai cells (Wu-Pong et al., 1994). To further characterize ribozyme uptake, the effects of the endocytosis inhibitor, phenylarsine oxide and the endosomal alkalinizers, chloroquine and monensin could be studied (Loke et al., 1989; Wu-Pong et al., 1994).

To determine whether specific binding sites are involved in the uptake of ribozyme RPI.4782 in U87-MG cells, competition studies are required to evaluate the effect on ribozyme uptake by competitors such as oligonucleotides, ATP and other polyanions, such as dextran sulphate and heparin. The cellular association of ribozyme RPI.4782 to U87-MG cells was also found to be pH dependent. In fact a decrease in pH from pH 8 to pH 5 resulted in a significant increase in cellular association. The effect of pH on ribozyme partition coefficients had not as yet been undertaken in order to determine whether the increase in cellular association was due to an increase in the partition coefficient of the ribozyme, at low pH conditions. The increase of cellular association at low pH is in agreement with the work of Goodarzi et al (1991) and Kitajima et al (1992) who found that cellular association of oligonucleotides also increased under acidic conditions. It has been postulated that enhanced binding could be due to the presence of a 34 kDa membrane protein receptor that functions around pH 4.5 (Goodarzi et al., 1991). In addition, the a amino group of lysine, the guanidium group of arginine and protonated imidazole of histidine have been suggested to be possible oligonucleotide binding sites (Blackburn et al., 1990). Histidine, having a pKa of 6.5 is susceptible to protonation over a pH range of 7.2 to 5.0. Therefore, the enhanced affinity of ribozyme RPI.4782 to U87-MG cells at pH 5.0 could be due to protonation of histidine residues present at the binding site.

In general these observations suggest that the pathway of cellular uptake of ribozyme involves an active cellular process; indications are that the predominant mechanism of uptake is via receptor mediated endocytosis.

Example 7

Ribozyme Stability in U87-MG Cells

In order to ensure that the results obtained from the uptake studies represented cell association of intact 37 mer ribozyme and not degraded ribozyme or free [$^{32}$P] label, the stability of this ribozyme,when incubated with U87 cells, was examined.

U87-MG cells were seeded onto 24 well-plates as previously described and used approximately 24 hours post seeding. Internally [$^{32}$P] labelled ribozyme RPI.4782 was added to 200 μl of serum free media to give a final concentration of 10 nM. 10 μl aliquots of the apical solution were colleced at variable time points over a period of 4 hours, mixed with an equal volume of formamide loading buffer (9:1 v/v formamide: 1×TBE) and stored at −20 C Prior to gel loading, the samples were heated to 100° C. for 5 minutes and separated on 7M urea/20% acrylamide gels; bands were detected by autoradiography of wet gels.

For comparative purposes, the stability profiles of 5' labelled ribozyme RPI.4782, 5' end labelled all RNA 15 mer substrate, and 5' end labelled 37 mer PO and PS oligodeoxynucleotides were also measured under the same conditions.

To ensure that any findings obtained from uptake studies represented the cellular association of intact 37 mer ribozyme and not that of shorter degraded fragments or free [$^{32}$P] label, the degradation of 5'-end and internally [$^{32}$P] labelled ribozyme was examined when exposed to U87-MG cells. For comparative purposes, the stability profile of an unmodified RNA substrate was also measured under the same conditions. The chemically modified ribozyme remained largely intact throughout a four hour incubation period. While no degradation was evident from the internally labelled sample, the 5'-end labelled ribozyme did exhibit some degradation after 120 minutes. This indicates that 5' dephosphorylation occured in the latter case. In contast, however, the unmodified RNA substrate was completely degraded within 10 minutes incubation with the U87-MG cell monolayer. The ribozyme was clearly protected from cellular nucleases by the chemical modifications previously described.

Optimizing Ribozyme Activity

Sullivan, et al., supra, describes the general methods for delivery of enzymatic RNA molecules. The data presented in Examples above indicate that different cationic lipids can deliver active ribozymes to smooth muscle cells. Experiments similar to those performed in above-mentioned Examples are used to determine which lipids give optimal delivery of ribozymeis to specific cells. Other such delivery methods are known in the art and can be utilized in this invention.

The proliferation of smooth muscle cells can also be inhibited by the direct addition of chemically stabilized ribozymes. Presumably, uptake is mediated by passive diffusion of the anionic nucleic acid across the cell membrane. In this case, efficacy could be greatly enhanced by directly coupling a ligand to the ribozyme. The ribozymes are then delivered to the cells by receptor-mediated uptake. Using such conjugated adducts, cellular uptake can be increased by several orders of magnitude without having to alter the phosphodiester linkages necessary for ribozyme cleavage activity.

Alternatively, ribozymes may be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. The RNA/vehicle combination is locally delivered by direct injection or by use of a catheter, infusion pump or stent. Alternative routes of delivery include, but are not limited to, intramuscular injection, aerosol inhalation, oral (tablet or pill form), topical, systemic, ocular, intraperitoneal and/or intrathecal delivery. More detailed descriptions of ribozyme delivery and administration are provided in Sullivan, et al., supra and Draper, et al., supra which have been incorporated by reference herein.

Chemical modifications, ribozyme sequences and ribozyme motifs described in this invention are meant to be non-limiting examples, and those skilled in the art will recognize that other modifications (base, sugar and phosphate modifications) to enhance nuclease stability of a ribozyme can be readily generated using standard techniques and are hence within the scope of this invention.

Use of Ribozymes Targeting EGFR

Overexpression of the EGFR has been reported in a number of cancers (see above). Thus, inhibition of EGFR expression (for example using ribozymes) can reduce cell proliferation of a number of cancers, in vitro and in vivo and can reduce their proliferative potential.

Ribozymes, with their catalytic activity and increased site specificity (see above), are likely to represent a potent and safe therapeutic molecule for the treatment of cancer. In the present invention, ribozymes are shown to inhibit smooth muscle cell proliferation and stromelysin gene expression.

From those practiced in the art, it is clear from the examples described, that the same ribozymes may be delivered in a similar fashion to cancer cells to block their proliferation. These ribozymes can be used in conjunction with existing cancer therapies.

Gliomas are the most common primary tumors arising from the brain, in fact each year malignant gliomas account for approximately 2.5% of the deaths from cancer (Bruner, 1994). These gliomas are morphologically and biologically heterogeneous and include neoplasms derived from several cell types. Astrocytomas form the largest single group among the primary tumors (75–90%) which also includes oligodendrogliomas, ependymomas and mixed gliomas (Bruner, 1994). Distinct histological features allow astrocytomas to be graded into levels of anaplasia, the most widely used today involves a three tiered grading system (Ringertz, 1950) dividing astrocytomas into low grade astrocytomas, anaplastic astrocytomas and glioblastomas The most malignant and frequently occurring form, glioblastoma multiforme (GBM), accounts for approximately one third of all primary brain tumors (Wong et al., 1994). This tumor is so undifferentiated that it cell of origin remains obscure, however most examples are generally thought to arise from astrocytes because glial fibrillary acidic protein (GFAP), a histological marker for astrocytes, can be identified in the cell cytoplasm. The histological morphology of glioblastoma can be highly variable, confirming the name "multiforme".

The characteristic features of glioblastoma multiforme is tumor necrosis.

The individual cells may be small with a high nuclear/cytoplasmic ratio or very large and bizarre with abundant eosinophilic cytoplasm. The small cells are the more proliferative ones and show a more aggressive course. In fact some glioblastomas are so highly cellular that the population of small anaplastic cells stimulates primitive neuroectodermal tumors such as medulloblastoma. These small cells often appear to condense around areas of tumor necrosis forming characteristic "pseudopalisades". They also have the propensity to infiltrate the brain extensively, giving the appearance of multifocal gliomas.

Despite advances in many areas of cancer research and treatment, glioblastoma multiforme almost always proves fatal, with a median survival rate of less than one year and a 5 year survival rate of 5.5% or less (Martuza et al., 1991). At present, no therapeutic modality has substantially changed the outcome of patients with glioblastoma. Characteristics of this type of tumor, including it's invasive nature, it's ability to spread locally and distantly while avoiding recognition by the immune system, it's relative resistance to radiation and a high local recurrence rate, limit the success of conventional therapy. The effective treatment of glioblastoma multiforme, therefore, presents a tremendous challenge.

The current methods of treatment used in the management of malignant gliomas are briefly reviewed.

Surgery: The cornerstone of therapy for glioblastoma multiforme tumors has been surgery. The use of microsurgical techniques, intraoperative ultrasonic aspiration, electrophysiologic monitoring and lasers make the surgical procedure safe and accurate (Komblith et al., 1993). Although surgery does improve the survival of patients with glioblastoma multiforme, the inability to surgically remove eloquent areas of cerebral cortex invaded by the tumor render such ablative technologies of only modest value.

Radiotherapy: Malignant gliomas such as glioblastoma multiforme exhibit an extraordinary resistance to radiotherapy and as a consequence the effectiveness of this form of treatment is limited. The sensitivity of the surrounding, unaffected, brain limits the dose that can safely be delivered to 60Gy (Leibel et al., 1994), which is well below the level required to completely eradicate the primary tumor in the majority of patients. In addition, whole brain radiotherapy does not prevent local tumor recurrence. The effective use of more localized forms of radiotherapy, such as radiosensitizers and radiosurgical techniques, are at present under review.

Chemotherapy: Chemotherapy has been shown to be effective adjuncts to surgery and radiotherapy in the treatment of cancer. Unfortunately, however, chemotherapy has had a limited impact on survival in patients with high grade astrocytomas. A report published in 1993 determined that adding chemotherapy to surgery and radiation improved the median survival duration in these patients from 9.4 to 12 months (Fine et al., 1993).

Generally, the relatively lipid soluble and non ionized nitrosourea drugs; e.g. carmustine, lomustine, semustine and nimustine, have proved to be the most active single chemotherapy agents for treating malignant astrocytomas (Lesser & Grossman, 1994). New drugs continue to enter clinical trials in patients with glioblastoma; none so far, however, have substantially prolonged a patient's life span. A myriad of physiological and biological factors such as the blood brain barrier, heterogeneous and resistant tumor cell populations and unacceptable toxicities have limited the efficacy of these agents.

Different routes of administration have been used to overcome the impenetrability of the blood brain barrier. A unique delivery system has been reported (Brem et al., 1991) which incorporates biodegradable polymers impregnated with chemotherapy agents. These polymers are placed topically at the resection site and slowly release the drugs as they degrade. Direct injection into tumors may also be useful as a means to deliver the highest dose to the tumor site without systemic exposure.

Immunotherapy: Glioblastoma multiforme is an appropriate target for immunological directed therapy. Studies have revealed that sera from patients with GBM stimulates little or no humoral response. A realistic approach, therefore, is to stimulate a stronger immune response in glioblastoma patients. Although this approach looks promising in theory, as yet no effective means of stimulating a clinically immune response has been identified. The most promising avenue, through the use of lymphokine activated killer (LAK) cells and interleukin-2, has been limited by lack of tumor specific cell homing and difficulties with LAK cell delivery and toxicity.

Advances in the understanding of the molecular basis of cancer has now made it possible to design molecules that specifically interact with cancer cells. The most promising modes of therapy for the treatment of GBM, therefore, may lie with molecular based technologies which employ genetic interventions to alter the properties or behaviour of specific cells.

In fact, glioblastoma multiforme tumors are ideal candidates for this type of therapy since they rarely metastasize, are accessible to direct delivery techniques and can be precisely monitored by MRI and CT scans. The tumor cells may also divide rapidly, which enables agents such as retroviruses to infect the cells and synthesize genes leading to tumor cell destruction. (Kornblith et al., 1993).

Many detailed cytogenetic studies have been performed on malignant gliomas and these reveal commonly occurring abnormalities (Bigner & Vogelstein, 1990). For example, approximately 80% of malignant gliomas have gains of one or more copies of chromosome 7 and approximately 60% show a loss of chromosome 10. In addition, one of the most consistent genetic abnormalities is the presence of double minute chromosomes (DMs). Double minute chromosomes refer to small portions of chromosomes which are paired but lack a centromere; they are the karyotypic manifestation of gene amplification. The presence of such DMs have been found in over 50% of glioblastomas, with some tumors possessing 50–100 copies of DMs per cell (Ostrowski et al., 1994). This indicates that gene amplification in a cancer cell is a key method of increasing a certain amount of protein.

REFERENCES

Adams et al., (1994), *Tetrahedron Letters*, 35, 1597–1600.

Akhtar et al., (1992) *Trends In Cell Biology*, 2, 139–143.

Akhtar et al., (1996) *In Press*.

Akhtar et al., (1995) *Nature Medicine*, 1 (4), 300–302.

Akhtar et al., (1991) *Life Sciences*, 49, 1793–1801.

Ali et al., (1994) *Gene Therapy*, 1, 367–384.

Altman (1993) *Proceedings Of The National Acadamy Of Sciences, USA.*, 90, 10898–10900.

Amiri et al., (1994) *Biochemistry*, 33, 13172–13177.

Aurup et al., (1995) In: Akhtar, S. (Ed), *Delivery Strategies For Antisense Oligonucleotide Therapeutics*. London, Crc Press. Pp161–177.

Ayers et al., (1996) *Journal Of Controlled Release*, 38, 167–175.

Bacchetti et al., 1995 *International Journal Of Oncology*, 7, 423–432.

Barinaga (1993) Science, 262, 1512–1514.

Bassi et al., 1995 *Nat. Struct. Biol.*, 2, 45–55.

Beck et al., 1997 *Submitted*.

Beigelman et al., 1994 *Biorg. Med. Chem. Lett*, 4, 1715–1720.

Beigelman et al., 1995 *Nucleosides And Nucleotides*, 14, 895–899.

Beigelman et al., 1995 b *Nucleic Acids Research*, 23(21), 4434–4442.

Beigelman et al., 1995 C *Journal Of Biological Chemistry*, 270(43), 25701–25708.

Beltinger et al., 1995 *J. Clin. Invest.*, 95, 1814–1823.

Bertrand et al., 1994 *Embo Journal*, 73: 2904–2912.

Bertrand et al., 1996 *Nucleic Acids And Molecular Biology*, 10, 301–313.

Bertrand et al., 1994 *Nucleic Acids Research*, 22 (3), 293–300.

Bigner et al., 1990 *Brain Pathol.*, 1, 12–18.

Black et al., 1991 *New England Journal Of Medicine*, 324, 1471–1476 & 1555–1564.

Bratty et al, 1993 *Biochimica Et Biophysica Acta*. 1216, 345–359.

Brem et al., 1991 *Journal Of Neurosurgery*, 74, 441–446.

Bruner, 1994 *Seminars In Oncology*, 21(2), 126–138.

Cech et al., 1986 *Annual Review Of Biochemistry*, 55, 599–629.

Cech et al., 1994 *Nature*, 372, 39–40.

Cech et al., 1981 *Cell*, 27, 487–496.

Chadeneau et al., 1995 *Oncogene*, 11, 893–898.

Chen et al., 1996 *Cancer Gene Therapy*, 3(1), 18–23.

Crooke, 1992 *Annual Review Of Pharmacology*, 32, 329–379.

Denman,. 1993 *Biocomputing*, 15(6) 1090–1094.

Denman, 1996 *Febs Letters*, 382, 116–120.

Downward 1984 *Nature*, 307, 521–527.

Dropulic et al., 1993 *Antisense Research And Development*, 3, 87–94.

Elkins et al., 1995 In: Akhtar, S. *Delivery Stratergies For Antisense Oligonucleotide Therapeutics*. London, Crc Press. Pp17–37.

Ellis et al., 1993 *Nucleic Acids Research.* 21(22), 5171–5178.

Eckstein, 1985 *Annual Review Of Biochemistry*, 54, 367–402.

Ekstrand et al., 1991 *Cancer Research*, 51, 2164–2172.

Fedor et al., 1990 *Proceedings Of The National Acadamy Of Sciences, USA*, 87, 1668–1672.

Fedor et al., 1992 *Biochemistry*, 31, 12042–12054.

Feigner et al., 1994 *Journal Of Biological Chemistry*, 269, 2550–2561.

Feng et al., 1995 *Science*, 69, 1236–1241.

Fine et al., 1993 *Cancer*, 71, 2585–2597.

Flory et al., 1996 *Proceedings Of The National Acadamy Of Sciences, USA*, 93, 754–758.

Foster et al., 1987 *Cell*, 49, 211–220.

Fu et al., 1992 *Proceedings Of The National Acadamy Of Sciences, USA*, 89, 3985–3989.

Gait et al., 1995 *Nucleosides And Nucleotides*, 14 (3–5), 1133–1144.

Gish et al., 1989 *Trends In Biochemical Sciences*, 14, 97–100.

Goodarzi et al., 1991 *Biochem. Biophys. Res. Comm*, 181, 1343–1351.

Goodchild et al., 1990 *Nucleic Acids Research*, 20, 4607–4612.

Griffiths et al., 1987 *Nucleic Acids Research*, 15, 4145–4162.

Guerrier-Takda et al., 1983 *Cell*, 35, 849–857.

Gutierrez et al., 1992 *Lancet*, 339, 715–719.

Hampel, A. et al., 1990 *Nucleic Acids Research*, 18, 299–304.

Healy 1995 *Oncology Research*, 7(3), 121–130.

Heidenreich et al., 1994 *Journal Of Biological Chemistry*, 269, 2131–2138.

Heidenreich et al., 1993 *Faseb Journal*, 7, 90–96.

Hendry et al., 1995 *Nucleic Acids Research*, 23(19), 3928–3936.

Herschlag et al., 1994 *Embo Journal*, 13, 2913–2924.

Hertel et al., 1992 *Nucleic Acids Research*, 20 (12), 3252.

Hertel et al., 1994 *Biochemistry*, 33, 3374–3385.

Homann et al., 1994 *Nucleic Acids Research*, 22, 3951–3957.

Inoue, T. (1994) Time To Change Parthers. *Nature*, 370, 99–100.

Jaeger, J. A. Tumer, D. H., Zuker, M. (1989). Improved Predictions Of Secondary Structures For Rna, *Proceedings Of The National Acadamy For Sciences, USA*, 86, 7706–7710.

Jarvis et al., 1996 *RNA* 2, 419–428

Juliano et al., 1992 *Antisense Research And Develpment*, 2, 165.

Kanazawa et al., 1996 *Biochemical And Biophysical Research Communication*, 225, 570–576.

Kariko et al., 1994 *Febs Letters*, 352, 41–44.

Khazaie et al., 1993 *Cancer And Metastasis Review*, 12, 255–274.

Kiehntopf et al., 1995 a *Journal Of Molecular Medicine*, 73, 65–71.

Keihntopf, M., Esquivel, E. L., Brach, M. A., Hermann, F. (1 995b) Clinical Applications Of Ribozymes. *The Lancet*, 345, 1027–1031.

Keihntopf et al., 1994 *Embo Journal*, 13, 4645–4652.

Kim et al., 1994 *Science*, 266, 2011–2015.

Kisich et al., 1995 *Journal Of Cellular Biochemistry*, 19a, 291.

Koizumi et al., 1993 *Biol. Pharm. Bull.*, 16, 879–883.

Kornblith et al., 1994 *Surg. Neurol*, 39, 538–43.

Kumar et al., 1996 *Nucleic Acids And Molecular Biology*, 10, 217–230.

Kung et al., 1994 In: Pretlow, T. G. & Pretlow, T. P. (Eds) *Biochemical And Molecular Aspects Of Selected Cancers*, Volume 2, San Diego, Academic Press, 19–45.

L'huillier et al., 1996 *Nucleic Acids And Molecular Biology*, 10, 283–299.

Lamond et al., 1993 *Febs Letters*, 325(1), 123–127.

Lange et al., 1994 *Leukemia*, 7(11), 1786–1794.

Leibel et al., 1994 *Seminars In Oncology*, 21(2), 198–219.

Leopold et al., 1995 *Blood*, 85, 2162–2170.

Lesser, G. L. & Grossman, S. (1994) The Chemotherapy Of High Grade Astrocytomas. *Seminars In Oncology*, 21(2), 220–235.

Lewis et al., 1995 *Journal Of Cellular Biochemistry*, 19a, 227.

Loke et al., 1989 *Proceedings Of The National Acadamy Of Sciences, USA*, 88, 3474–3478.

Lyngstadaas et al., 1995 *Embo Journal*, 14(21), 5224–5229

Marshall et al., 1993 *Science*, 259, 1565–1569.

Marschall et al., 1994 *Cellular And Molecular Neurobiology*, 14 (5), 523–538.

Martuza et al., 1991 *Science*, 252, 854–855.

Miller et al., 199 *Virology*, 183, 711–720.

Milligan et al., 1993 *Journal Of Medicinal Chemistry*, 36(14) 1923–1937.

Modjtahedi et al., 1994 *International Journal Of Cancer*, 4, 277–296.

Morvan et al., 1990 *Tetrahedron Letters*, 31, 7149–7152.

Ohkawa et al., 1995 *Journal Of Biochemistry*, 118, 251–258.

Olsen et al., 1991 *Biochemistry*, 31, 9735–9741.

Ostrowski et al., 1994 In Human Malignant Glioma. In: Pretlow, T. G. & Pretlow, T. P. (Eds) *Biochemical And Molecular Aspects Of Selected Cancers*. San Diego, Academic Press, 143–168.

Paolella et al., 1992 *Embo Journal*, 11(5), 1913–1919.

Perreault et al., 1990 *Nature*, 334, 565–567.

Perriman et al., 1995 *Proceedings Of The National Academy Of Sciences, USA*, 92, 6175–6179.

Perriman et al., 1992 *Gene*, 113, 157–163.

Pieken et al., 1991 *Science*, 253, 314–317.

Pley, H. W., Flaherty, K. M. & Mckay, D. B. (1994) Three-Dimensional Structure Of A Hammerhead Ribozyme. *Nature*, 372, 68–74.

Ponten et al., 1968 *Acta Path. Microbiol. Scandinav*, 74, 465–486.

Puttaraju et al., 1993 *Nucleic Acids Research*, 21, 4253–4258.

Rawls 1996 *Chemical And Engineering News*, 74(5), 26–28.

Reddy 1996 *Drugs Of Today*, 32(2), 113–137.

Ringertz, 1950 *Acta. Pathol. Microbiol. Scand.*, 27, 51–64.

Rossi 1994 *Current Biology*, 4(5), 469–471.

Rossi 1995 *Tibtech*, 13, 301–305.

Rossi et al., 1992 *Aids Res. Hum. Retroviruses*, 8, 183–189.

Ruffner et al., 1990 *Nucleic Acids Research*, 18, 6025.

Ruffner, et al., 1990 *Biochemistry*, 29, 10695–10702.

Rhyu 1995 *Journal Of The National Cancer Institute*, 87(12), 884–894.

Sambrook 1989 *Molecular Cloning: A Laboratory Manual*, Second Edition, Vols 1, 2 &3. Cold Srings Harbor, Laboratory Press.

Scaringe et al., 1990 *Nucleic Acids Research*, 18, 5433–5441.

Scott et al., 1995 *Cell*, 81, 991–1002.

Sczakiel 1996 *Nucleic Acids And Molecular Biology*, 10, 231–241.

Sczakiel et al., 1994 *Biol. Chem. Hoppe-Seyler*, 375, 745–746.

Sczakiel et al., 1993 *Antisense Research And Development*, 3, 45–52.

Shaw et al., 1991 *Nucleic Acids Research*, 19 (4), 747–750.

Shibahara et al., 1986 *Nucleic Acids Research*, 17, 239–242.

Shimayama et al., 1993 *Nucleic Acids Research*, 21, 2605–2611.

Shimayama et al., 1995 *Biochemistry*, 34, 3649–3654.

Shoji et al., 1991 *Nucleic Acids Research*, 19 (20), 5543–5550.

Shoji et al., 1996 *Antimicrobial Agents And Chemotherapy*, 40 (7), 1670–1675.

Sioud et al., 1992 *Journal Of Molecular Biology*, 223, 831–835.

Snyder et al., 1993 *Blood*, 82, 600–605.

Sporn et al., 1985 *Nature*, 313, 745–747.

Sproat 1996 *Nucleic Acids And Molecular Biology*, 10, 265–281.

Stein et al., 1988 *Gene*, 72, 333–341.

Stein et al., 1993 *Science*, 261, 1004–1006.

Stein et al., 1993 *Biochemistry*, 32, 4855–4861.

Suh et al., 1993 *Febs Letters*, 326 (1,2,3), 158–162.

Sullinger et al., 1993 *Science*, 262, 1566–1569.

Sullivan, 1993 *A Companion To Methods In Enzymology*, 5, 61–66.

Sullivan, 1994 *The Journal Of Investigative Dermatology*, 1.00(5), 85s–89s.

Symons, R. H. (1992) Small Catalytic Rnas. *Annual Review Of Biochemistry*, 61, 641–671.

Symon, 1994 *Current Biology*, 4, 322–330.

Szostak 1993 *Nature*, 361, 119–120.

Tayler et al., 1992 *Nucleic Acids Research*, 20 (17), 4559–4565.

Thierry et al., 1995 In: Akhtar, S (Ed), Delivery Strategies For Antisnse Oligonucleotide Therapeutics, London, Crc Press.

Thomson et al., 1993 *Nucleic Acids Research*, 21, 5600–5603.

Thomson et al., 1996 *Nucleic Acids And Molecular Biology*, 19, 172–196

Thompson et al., 1995 *Nature Medicine*, 1(3), 277–278.

Tidd et al., 1989 *British Journal Of Cancer*, 60, 343–350.

Tsuchihashi et al., 1993 *Science*, 262, 99–102.

Tuschl et al., 1993 *Proceedings Of The National Acadamy Of Sciences, USA*, 90, 6991–6994.

Tuschl, T., Gohlke, C., Jovin, T. M., Westhof, E., Eckstein, F. (1995) A Three Dimentional Model For The Hammerhead Ribozyme Based On Fluorescence Measurements. *Science*, 266, 785–788.

Uhlenbeck, 1987 *Nature*, 328, 596–600.

Usman et al., 1992 *Trends In Biochemical Science*, 17, 334–339.

Usman et al., 1996 *Annual Reports In Medicinal Chemistry*, 30, 285–294.

Usman et al., 1996 *Nucleic Acids And Molecular Biology*, 10, 243–263.

Werner et al., 1995 *Nucleic Acids Research*, 23, 2092–2096.

Williams et al., 1992 *Proceedings Of The National Acadamy Of Science, USA*, 89, 918–921.

Wincott et al., 1995 *Nucleic Acids Research*, 23 (14) 2677–2684.

Wong et al., 1994 *Seminars In Oncology*, 21(2), 139–148

Wu et al., 1989 *Proceeding Of The National Acadamy Of Sciences, USA*, 86, 18

Wu-Pong et al., 1994 *Antisense Research And Development*, 4, 155–163.

Yakubov et al., 1989 *Proceedings Of The National Academy Of Sciences, USA*, 86, 6454–6458.

Yang et al., 1992 *Biochemistry*, 31, 5005–5009.

Young et al., 1993 *Febs Letters*, 326, 158

Yu et al., 1993 *Proceedings Of Th National Academy Of Science, USA*, 90, 6340–6344.

Zuker et al., (1991) *Nucleic Acids Research*, 19(10), 2707–2714

Diagnostic Uses

Ribozymes of this invention may be used as diagnostic tools to examine genetic drift and mutations within diseased cells or to detect the presence of EGFR RNA in a cell. The close relationship between ribozyme activity and the structure of the target RNA allows the detection of mutations in any region of the molecule which alters the base-pairing and three-dimensional structure of the target RNA. By using multiple ribozymes described in this invention, one may map nucleotide changes which are important to RNA structure and function in vitro, as well as in cells and tissues. Cleavage of target RNAs with ribozymes may be used to inhibit gene expression and define the role (essentially) of specified gene products in the progression of disease. In this manner, other genetic targets may be defined as important mediators of the disease. These experiments will lead to better treatment of the disease progression by affording the possibility of combinational therapies (e.g., multiple ribozymes targeted to different genes, ribozymes coupled with known small molecule inhibitors, or intermittent treatment with combinations of ribozymes and/or other chemical or biological molecules). Other in vitro uses of ribozymes of this invention are well known in the art, and include detection of the presence of mRNAs associated with EGFR related condition. Such RNA is detected by determining the presence of a cleavage product after treatment with a ribozyme using standard methodology.

In a specific example, ribozymes which can cleave only wild-type or mutant forms of the target RNA are used for the assay. The first ribozyme is used to identify wild-type RNA present in the sample arid the second ribozyme will be used to identify mutant RNA in the sample. As reaction controls, synthetic substrates of both wild-type and mutant RNA will be cleaved by both ribozymes to demonstrate the relative ribozyme efficiencies in the reactions and the absence of cleavage of the "non-targeted" RNA species. The cleavage products from the synthetic substrates will also serve to generate size markers for the analysis of wild-type and mutant RNAs in the sample population. Thus each analysis will require two ribozymes, two substrates and one unknown sample which will be combined into six reactions. The presence of cleavage products will be determined using an RNAse protection assay so that full-length and cleavage fragments of each RNA can be analyzed in one lane of a polyacrylamide gel. It is not absolutely required to quantify the results to gain insight into the expression of mutant RNAs and putative risk of the desired phenotypic changes in target cells. The expression of mRNA whose protein product is implicated in the development of the phenotype (i.e., EGFR) is adequate to establish risk. If probes of comparable specific activity are used for both transcripts, then a qualitative comparison of RNA levels will be adequate and will decrease the cost of the initial diagnosis. Higher mutant form to wild-type ratios will be correlated with higher risk whether RNA levels are compared qualitatively or quantitatively.

Other embodiments are within the following claims.

TABLE I

Characteristics of naturally occurring ribozymes

Group I Introns

Size: ~150 to >1000 nucleotides.
Requires a U in the target sequence immediately 5' of the cleavage site.
Binds 4–6 nucleotides at the 5'-side of the cleavage site.
Reaction mechanism: attack by the 3'-OH of guanosine to generate cleavage products with 3'-OH and 5'-guanosine.
Additional protein cofactors required in some cases to help folding and maintainance of the active structure [1].
Over 300 known members of this class. Found as an intervening sequence in *Tetrahymena thermophila* rRNA, fungal mitochondria, chloroplasts, phage T4, blue-green algae, and others.
Major structural features largely established through phylogenetic comparisons, mutagenesis, and biochemical studies [2,3].
Complete kinetic framework established for one ribozyme [4,5,6,7].
Studies of ribozyme folding and substrate docking underway [8,9,10].
Chemical modification investigation of important residues well established [11,12].
The small (4–6 nt) binding site may make this ribozyme too non-specific for targeted RNA cleavage, however, the Tetrahymena group I intron has been used to repair a "defective" β-galactosidase message by the ligation of new β-galactosidase sequences onto the defective message [13].

RNAse P RNA (M1 RNA)

Size: ~290 to 400 nucleotides.
RNA portion of a ubiquitous ribonucleoprotein enzyme.
Cleaves tRNA precursors to form mature tRNA [14].
Reaction mechanism: possible attack by $M^{2+}$-OH to generate cleavage products with 3'-OH and 5'-phosphate.
RNAse P is found throughout the prokaryotes and eukaryotes. The RNA

TABLE I-continued

Characteristics of naturally occurring ribozymes subunit has been sequenced from bacteria, yeast, rodents, and primates.
Recruitment of endogenous RNAse P for therapeutic applications is
possible through hybridization of an External Guide Sequence (EGS) to
the target RNA [15,16]
Important phosphate and 2' OH contacts recently identified [17,18]

Group II Introns

Size: >1000 nucleotides.
Trans cleavage of target RNAs recently demonstrated [19,20].
Sequence requirements not fully determined.
Reaction mechanism: 2'-OH of an internal adenosine generates cleavage
products with 3'-OH and a "lariat" RNA containing a 3'-5' and a 2'-5'
branch point.
Only natural ribozyme with demonstrated participation in DNA cleavage
[21,22] in addition to RNA cleavage and ligation.
Major structural features largely established through phylogenetic
comparisons [23].
Important 2' OH contacts beginning to be identified [24]
Kinetic framework under development [25]

Neurospora VS RNA

Size: ~144 nucleotides.
Trans cleavage of hairpin target RNAs recently demonstrated [26].
Sequence requirements not fully determined.
Reaction mechanism: attack by 2'-OH 5' to the scissile bond to generate
cleavage products with 2',3'-cyclic phosphate and 5'-OH ends.
Binding sites and structural requirements not fully determined.
Only 1 known member of this class. Found in Neurospora VS RNA.

Hammerhead Ribozyme
(see text for references)

Size: ~13 to 40 nucleotides.
Requires the target sequence UH immediately 5' of the cleavage site.
Binds a variable number nucleotides on both sides of the cleavage site.
Reaction mechanism: attack by 2'-OH 5' to the scissile bond to generate
cleavage products with 2',3'-cyclic phosphate and 5'-OH ends.
14 known members of this class. Found in a number of plant pathogens
(virusoids) that use RNA as the infectious agent.
Essential structural features largely defined, including 2 crystal
structures [ ]
Minimal ligation activity demonstrated (for engineering through in vitro
selection) [ ]
Complete kinetic framework established for two or more ribozymes [ ].
Chemical modification investigation of important residues well
established [ ].

Hairpin Ribozyme

Size: ~50 nucleotides.
Requires the target sequence GUC immediately 3' of the cleavage site.
Binds 4–6 nucleotides at the 5'-side of the cleavage site and a variable
number to the 3'-side of the cleavage site.
Reaction mechanism: attack by 2'-OH 5' to the scissile bond to generate
cleavage products with 2',3'-cyclic phosphate and 5'-OH ends.
3 known members of this class. Found in three plant pathogen (satellite
RNAs of the tobacco ringspot virus, arabis mosaic virus and chicory
yellow mottle virus) which uses RNA as the infectious agent.
Essential structural features largely defined [27,28,29,30]
Ligation activity (in addition to cleavage activity) makes ribozyme
amenable to engineering through in vitro selection [31]
Complete kinetic framework established for one ribozyme [32].
Chemical modification investigation of important residues begun [33,34].

Hepatitis Delta Virus (HDV) Ribozyme

Size: ~60 nucleotides.
Trans cleavage of target RNAs demonstrated [35].
Binding sites and structural requirements not fully determined, although no
sequences 5' of cleavage site are required. Folded ribozyme contains a
pseudoknot structure [36].
Reaction mechanism: attack by 2'-OH 5' to the scissile bond to generate
cleavage products with 2',3'-cyclic phosphate and 5'-OH ends.
Only 2 known members of this class. Found in human HDV.
Circular form of HDV is active and shows increased nuclease stability
[37]

1. Mohr, G.; Caprara, M. G.; Guo, Q.; Lambowitz, A. M. Nature, 370 147–150 (1994).
2. Michel, Francois; Westhof, Eric. Slippery substrates. Nat. Struct. Biol. (1994), 1(1), 5–7.
3. Lisacek, Frederique; Diaz, Yolande; Michel, Francois. Automatic identification of group I intron cores in genomic DNA sequences. J. Mol. Biol. (1994), 235(4), 1206–17.
4. Herschlag, Daniel; Cech, Thomas R., Catalysis of RNA cleavage by the Tetrahymena thermophila ribozyme 1. Kinetic description of the reaction of an RNA substrate complmentary to the active site. Biochemistry (1990), 29(44), 10159–71.
5. Herschlag, Daniel; Cech, Thomas R., Catalysis of RNA cleavage by the Tetrahymena thermophila ribozyme 2. Kinetic description of the reaction of an RNA substrate that forms a mismatch at the active site. Biochemistry (1990), 29(44), 10172–80.
6. Knitt, Deborah S.; Herschlag, Daniel. pH Dependencies of the Tetrahymena Ribozyme Reveal an Unconventional Origin of an Apparent pKa. Biochemistry (1996), 35(5), 1560–70.
7. Bevilacqua, Philip C.; Sugimoto, Naoki; Turner, Douglas H., A mechanistic framework for the second step of splicing catalyzed by the Tetrahymena ribozyme. Biochemistry (1996), 35(2), 648–58.
8. Li, Yi; Bevilacqua, Philip C.; Mathews, David; Turner, Douglas H., Thermodynamic and activation parameters for binding of a pyrene-labeled substrate by the Tetrahymena ribozyme: docking is not diffusion-controlled and is driven by a favorable entropy change. Biochemistry (1995), 34(44), 14394–9.
9. Banerjee, Aloke Raj; Turner, Douglas H., The time dependence of chemical modification reveals slow steps in the folding of a group I ribozyme. Biochemistry (1995), 34(19), 6504–12.
10. Zarrinkar, Patrick P.; Williamson, James R., The P9.1–P9.2 peripheral extension helps guide folding of the Tetrahymena ribozyme. Nucleic Acids Res. (1996), 24(5), 854–8.
11. Strobel, Scott A.; Cech, Thomas R., Minor groove recognition of the conserved G.cntdot.U pair at the Tetrahymena ribozyme reaction site. Science (Washington, D.C.) (1995), 267(5198), 675–9.
12. Strobel, Scott A.; Cech, Thomas R., Exocyclic Amine of the Conserved G.cntdot.U Pair at the Cleavage Site of the Tetrahymena Ribozyme Contributes to 5'-Splice Site Selection and Transition State Stabilization. Biochemistry (1996), 35(4), 1201–11.
13. Sullenger, Bruce A.; Cech, Thomas R., Ribozyme-mediated repair of defective mRNA by targeted trans-splicing. Nature (London) (1994), 371 (6498), 619–22.
14. Robertson, H. D.; Altman, S.; Smith, J. D. J. Biol. Chem., 247, 5243–5251 (1972).
15. Forster, Anthony C.; Altman, Sidney. External guide sequences for an RNA enzyme. Science (Washington, D.C., 1883-) (1990), 249(4970), 783–6.
16. Yuan, Y.; Hwang, E. S.; Altman, S. Targeted cleavage of mRNA by human RNase P. Proc. Natl. Acad. Sci. USA (1992) 89, 8006–10.
17. Harris, Michael E.; Pace, Norman R., Identification of phosphates involved in catalysis by the ribozyme RNase P RNA. RNA (1995), 1(2), 210–18.
18. Pan, Tao; Loria, Andrew; Zhong, Kun. Probing of tertiary interactions in RNA: 2'-hydroxyl-base contacts between the RNase P RNA and pre-tRNA. Proc. Natl. Acad. Sci. U.S.A. (1995), 92(26), 12510–14.
19. Pyle, Anna Marie; Green, Justin B., Building a Kinetic Framework for Group II Intron Ribozyme Activity: Quantitation of Interdomain Binding and Reaction Rate. Biochemistry (1994), 33(9), 2716–25.
20. Michels, William J. Jr.; Pyle, Anna Marie. Conversion of a Group II Intron into a New Multiple-Turnover Ribozyme that Selectively Cleaves Oligonucleotides: Elucidation of Reaction Mechanism and Structure/Function Relationships. Biochemistry (1995), 34(9), 2965–77.
21. Zimmerly, Steven; Guo, Huatao; Eskes, Robert; Yang, Jian; Perlman, Philip S.; Lambowitz, Alan M., A group II intron RNA is a catalytic component of a DNA endonuclease involved in intron mobility. Cell (Cambridge, Mass.) (1995), 83(4), 529–38.
22. Griffin, Edmund A., Jr.; Qin, Zhifeng; Michels, Williams J., Jr.; Pyle, Anna Marie. Group II intron ribozymes that cleave DNA and RNA linkages with similar efficiency, and lack contacts with substrate 2'-hydroxyl groups. Chem. Biol. (1995), 2(11), 761–70.
23. Michel, Francois; Ferat, Jean Luc. Structure and activities of group II introns. Annu. Rev. Biochem. (1995), 64, 435–61.
24. Abramovitz, Dana L.; Friedman, Richard A.; Pyle, Anna Marie. Catalytic role of 2'-hydroxyl groups within a group II intron active site. Science (Washington, D.C.) (1996), 271(5254), 1410–13.
25. Daniels, Danette L.; Michels, William J., Jr.; Pyle, Anna Marie. Two competing pathways for self-splicing by group II introns: a quantitative analysis of in vitro reaction rates and products. J. Mol. Biol. (1996), 256 (1), 31–49.
26. Guo, Hans C. T.; Collins, Richard A., Efficient trans-cleavage of a stem-loop RNA substrate by a ribozyme derived from Neurospora VS RNA. EMBO J. (1995), 14(2), 368–76.

TABLE I-continued

Characteristics of naturally occurring ribozymes

27. Hampel, Arnold; Tritz, Richard; Hicks, Margaret; Cruz, Phillip. 'Hairpin' catalytic RNA model: evidence for helixes and sequence requirement for substrate RNA. Nucleic Acids Res. (1990), 18(2), 299–304.
28. Chowrira, Bharat M.; Berzal-Herranz, Alfredo; Burke, John M., Novel guanosine requirement for catalysis by the hairpin ribozyme. Nature (London) (1991), 354(6351), 320–2.
29. Berzal-Herranz, Alferdo; Joseph, Simpson; Chowrira, Bharat M.; Butcher, Samuel E.; Burke, John M., Essential nucleotide sequences and secondary structure elements of the hairpin ribozyme. EMBO J. (1993), 12(6), 2567–73.
30. Joseph, Simpson; Berzal-Herranz, Alfredo; Chowrira, Bharat M.; Butcher, Samuel E., Substrate selection rules for the hairpin ribozyme determined by in vitro selection, mutation, and analysis of mismatched substrates. Genes Dev. (1993), 7(1), 130–8.
31. Berzal-Herranz, Alfredo; Joseph, Simpson; Burke, John M., In vitro selection of active hairpin ribozymes by sequential RNA-catalyzed cleavage and ligation reactions. Genes Dev. (1992), 6(1), 129–34.
32. Hegg, Lisa A.; Fedor, Martha J., Kinetics and Thermodynamics of Intermolecular Catalysis by Hairpin Ribozymes. Biochemistry (1995), 34(48), 15813–28.
33. Grasby, Jane A.; Mersmann, Karin; Singh, Mohinder; Gait, Michael J., Purine Functional Groups in Essential Residues of the Hairpin Ribozyme Required for Catalytic Cleavage of RNA. Biochemistry (1995), 34(12), 4068–76.
34. Schmidt, Sabine; Beigelman, Leonid; Karpeisky, Alexander; Usman, Nassim; Sorensen, Ulrik S.; Gait, Michael J., Base and sugar requirements for RNA cleavage of essential nucleoside residues in internal loop B of the hairpin ribozyme: implications for secondary structure. Nucleic Acids Res. (1996), 24(4), 573–81.
35. Perrotta, Anne T.; Been, Michael D., Cleavage of oligoribonucleotides by a ribozyme derived from the hepatitis delta virus RNA sequence. Biochemistry (1992), 31(1), 16–21.
36. Perrotta, Anne T.; Been, Michael D., A pseudoknot-like structure required for efficient self-cleavage of hepatitis delta virus RNA. Nature (London) (1991), 350(6317), 434–6.
37. Puttaraju, M.; Perrotta, Anne T.; Been, Michael D., A circular trans-acting hepatitis delta virus ribozyme. Nucleic Acids Res. (1993), 21(18), 4253–8.

TABLE II

2.5 μmol RNA Synthesis Cycle

| Reagent | Equivalents | Amount | Wait Time* |
|---|---|---|---|
| Phosphoramidites | 6.5 | 163 μL | 2.5 |
| S-Ethyl Tetrazole | 23.8 | 238 μL | 2.5 |
| Acetic Anhydride | 100 | 233 μL | 5 sec |
| N-Methyl Imidazole | 186 | 233 μL | 5 sec |
| TCA | 83.2 | 1.73 mL | 21 sec |
| Iodine | 8.0 | 1.18 mL | 45 sec |
| Acetonitrile | NA | 6.67 mL | NA |

*Wait time does not include contact time during delivery.

TABLE III

Human EGF-R Hammerhead Ribozyme and Target Sequences

| nt. Position | Substrate | Seq. ID NOs. | Ribozyme | Seq. ID NOs. |
|---|---|---|---|---|
| 19 | GCCGGAGUC CCGAGCUA | 1 | UAGCUCGG CUGAUGA X GAA ACUCCGGC | 824 |
| 27 | CCCGAGCUA GCCCCGGC | 2 | GCCGGGGC CUGAUGA X GAA AGCUCGGG | 825 |
| 70 | GGCCACCUC GUCGGCGU | 3 | ACGCCGAC CUGAUGA X GAA AGGUGGCC | 826 |
| 73 | CACCUCGUC GGCGUCCG | 4 | CGGACGCC CUGAUGA X GAA ACGAGGUG | 827 |
| 79 | GUCGGCGUC CGCCCGAG | 5 | CUCGGGCG CUGAUGA X GAA ACGCCGAC | 828 |
| 89 | GCCCGAGUC CCCGCCUC | 6 | GAGGCGGG CUGAUGA X GAA ACUCGGGC | 829 |
| 97 | CCCCGCCUC GCCGCCAA | 7 | UUGGCGGC CUGAUGA X GAA AGGCGGGG | 830 |
| 137 | CCCUGACUC CGUCCAGU | 8 | ACUGGACG CUGAUGA X GAA AGUCAGGG | 831 |
| 141 | GACUCCGUC CAGUAUUG | 9 | CAAUACUG CUGAUGA X GAA ACGGAGUC | 832 |
| 146 | CGUCCAGUA UUGAUCGG | 10 | CCGAUCAA CUGAUGA X GAA ACUGGACG | 833 |
| 148 | UCCAGUAUU GAUCGGGA | 11 | UCCCGAUC CUGAUGA X GAA AUACUGGA | 834 |
| 152 | GUAUUGAUC GGGAGAGC | 12 | GCUCUCCC CUGAUGA X GAA AUCAAUAC | 835 |
| 172 | AGCGAGCUC UUCGGGGA | 13 | UCCCCGAA CUGAUGA X GAA AGCUCGCU | 836 |
| 174 | CGAGCUCUU CGGGGAGC | 14 | GCUCCCCG CUGAUGA X GAA AGAGCUCG | 837 |
| 175 | GAGCUCUUC GGGGAGCA | 15 | UGCUCCCC CUGAUGA X GAA AAGAGCUC | 838 |
| 197 | GCGACCCUC CGGGACGG | 16 | CCGUCCCG CUGAUGA X GAA AGGGUCGC | 839 |
| 219 | GCAGCGCUC CUGGCGCU | 17 | AGCGCCAG CUGAUGA X GAA AGCGCUGC | 340 |
| 240 | GCUGCGCUC UGCCCGGC | 18 | GCCGGGCA CUGAUGA X GAA AGCGCAGC | 841 |
| 253 | CGGCGAGUC GGGCUCUG | 19 | CAGAGCCC CUGAUGA X GAA ACUCGCCG | 842 |
| 259 | GUCGGGCUC UGGAGGAA | 20 | UUCCUCCA CUGAUGA X GAA AGCCCGAC | 843 |
| 276 | AAGAAAGUU UGCCAAGG | 21 | CCUUGGCA CUGAUGA X GAA ACUUUCUU | 844 |
| 277 | AGAAAGUUU GCCAAGGC | 22 | GCCUUGGC CUGAUGA X GAA AACUUUCU | 845 |
| 292 | GCACGAGUA ACAAGCUC | 23 | GAGCUUGU CUGAUGA X GAA ACUCGUGC | 346 |
| 300 | AACAAGCUC ACGCAGUU | 24 | AACUGCGU CUGAUGA X GAA AGCUUGUU | 847 |
| 308 | CACGCAGUU GGGCACUU | 25 | AAGUGCCC CUGAUGA X GAA ACUGCGUG | 848 |
| 316 | UGGGCACUU UUGAAGAU | 26 | AUCUUCAA CUGAUGA X GAA AGUGCCCA | 849 |
| 317 | GGGCACUUU UGAAGAUC | 27 | GAUCUUCA CUGAUGA X GAA AAGUGCCC | 850 |
| 318 | GGCACUUUU GAAGAUCA | 28 | UGAUCUUC CUGAUGA X GAA AAAGUGCC | 851 |
| 325 | UUGAAGAUC AUUUCUC | 29 | GAGAAAAU CUGAUGA X GAA AUCUUCAA | 852 |
| 328 | AAGAUCAUU UUCUCAGC | 30 | GCUGAGAA CUGAUGA X GAA AUGAUCUU | 853 |

TABLE III-continued

Human EGF-R Hammerhead Ribozyme and Target Sequences

| nt. Position | Substrate | Seq. ID NOs. | Ribozyme | Seq. ID NOs. |
|---|---|---|---|---|
| 329 | AGAUCAUUU UCUCAGCC | 31 | GGCUGAGA CUGAUGA X GAA AAUGAUCU | 854 |
| 330 | GAUCAUUUU CUCAGCCU | 32 | AGGCLGAG CUGAUGA X GAA AAAUGAUC | 855 |
| 331 | AUCAUUUUC UCAGCCUC | 33 | GAGGCUGA CUGAUGA X GAA AAAAUGAU | 856 |
| 333 | CAUUUUCUC AGCCUCCA | 34 | UGGAGGCU CUGAUGA X GAA AGAAAAUG | 857 |
| 339 | CUCAGCCUC CAGAGGAU | 35 | AUCCUCUG CUGAUGA X GAA AGGCUGAG | 858 |
| 350 | GAGGAUGUU CAAUAACU | 36 | AGUUAUUG CUGAUGA X GAA ACAUCCUC | 859 |
| 351 | AGGAUGUUC AAUAACUG | 37 | CAGUUAUU CUGAUGA X GAA AACAUCCU | 860 |
| 355 | UGUUCAAUA ACUGUGAG | 38 | CUCACAGU CUGAUGA X GAA AUUGAACA | 861 |
| 369 | GAGGUGGUC CUUGGGAA | 39 | UUCCCAAG CUGAUGA X GAA ACCACCUC | 862 |
| 372 | GUGGUCCUU GGGAAUUU | 40 | AAAUUCCC CUGAUGA X GAA AGGACCAC | 863 |
| 379 | UUGGGAAUU UGGAAAUU | 41 | AAUUUCCA CUGAUGA X GAA AUUCCCAA | 864 |
| 380 | UGGGAAUUU GGAAAUUA | 42 | UAAUUUCC CUGAUGA X GAA AAUUCCCA | 865 |
| 387 | UUGGAAAUU ACCAUGU | 43 | ACAUAGGU CUGAUGA X GAA AUUUCCAA | 866 |
| 388 | UGGAAAUUA CCUAUGUG | 44 | CACAUAGG CUGAUGA X GAA AAUUUCCA | 867 |
| 392 | AAUUACCUA UGUGCAGA | 45 | UCUGCACA CUGAUGA X GAA AGGUAAUU | 868 |
| 406 | AGAGGAAUU AUGAUCUU | 46 | AAGAUCAU CUGAUGA X GAA AUUCCUCU | 869 |
| 407 | GAGGAAUUA UGAUCUUU | 47 | AAAGAUCA CUGAUGA X GAA AAUUCCUC | 870 |
| 412 | AUUAUGAUC UUUCCUUC | 48 | GAAGGAAA CUGAUGA X GAA AUCAUAAU | 871 |
| 414 | UAUGAUCUU UCCUUCUU | 49 | AAGAAGGA CUGAUGA X GAA AGAUCAUA | 872 |
| 415 | AUGAUCUUU CCUUCUUA | 50 | UAAGAAGG CUGAUGA X GAA AAGAUCAU | 873 |
| 416 | UGAUCUUUC CUUCUUAA | 51 | UUAAGAAG CUGAUGA X GAA AAAGAUCA | 874 |
| 419 | UCUUUCCUU CUUAAAGA | 52 | UCUUUAAG CUGAUGA X GAA AGGAAAGA | 875 |
| 420 | CUUUCCUUC UUAAAGAC | 53 | GUCUUUAA CUGAUGA X GAA AAGGAAAG | 876 |
| 422 | UUCCUUCUU AAAGACCA | 54 | UGGUCUUU CUGAUGA X GAA AGAAGGAA | 877 |
| 423 | UCCUUCUUA AAGACCAU | 55 | AUGGUCUU CUGAUGA X GAA AAGAAGGA | 878 |
| 432 | AAGACCAUC CAGGAGGU | 56 | ACCUCCUG CUGAUGA X GAA AUGGUCUU | 879 |
| 448 | UGGCUGGUU AUGUCCUC | 57 | GAGGACAU CUGAUGA X GAA ACCAGCCA | 880 |
| 449 | GGCUGGUUA UGUCCUCA | 58 | UGAGGACA CUGAUGA X GAA AACCAGCC | 881 |
| 453 | GGUUAUGUC CUCAUUGC | 59 | GCAAUGAG CUGAUGA X GAA ACAUAACC | 882 |
| 456 | UAUGUCCUC AUUGCCCU | 60 | AGGGCAAU CUGAUGA X GAA AGGACAUA | 883 |
| 459 | GUCCUCAUU GCCCUCAA | 61 | UUGAGGGC CUGAUGA X GAA AUGAGGAC | 884 |
| 465 | AUUGCCCUC AACACAGU | 62 | ACUGUGUU CUGAUGA X GAA AGGGCAAU | 885 |
| 483 | GAGCGAAUU CCUUUGGA | 63 | UCCAAAGG CUGAUGA X GAA AUUCGCUC | 886 |
| 484 | AGCGAAUUC CUUUGGAA | 64 | UUCCAAAG CUGAUGA X GAA AAUUCGCU | 887 |
| 487 | GAAUUCCUU UGGAAAAC | 65 | GUUUUCCA CUGAUGA X GAA AGGAAUUC | 888 |
| 488 | AAUUCCUUU GGAAAACC | 66 | GGUUUUCC CUGAUGA X GAA AAGGAAUU | 389 |
| 504 | CUGCAGAUC AUCAGAGG | 67 | CCUCUGAU CUGAUGA X GAA AUCUGCAG | 890 |
| 507 | CAGAUCAUC AGAGGAAA | 68 | UUUCCUCU CUGAUGA X GAA AUGAUCUG | 891 |
| 517 | GAGGAAAUA UGUACUAC | 69 | GUAGUACA CUGAUGA X GAA AUUUCCUC | 892 |
| 521 | AAAUAUGUA CUACGAAA | 70 | UUUCGUAG CUGAUGA X GAA ACAUAUUU | 893 |
| 524 | UAUGUACUA CGAAAAUU | 71 | AAUUUUCG CUGAUGA X GAA AGUACAUA | 894 |
| 532 | ACGAAAAUU CCUAUGCC | 72 | GGCAUAGG CUGAUGA X GAA AUUUUCGU | 895 |
| 533 | CGAAAAUUC CUAUGCCG | 73 | AGGCAUAG CUGAUGA X GAA AAUUUUCG | 896 |
| 536 | AAAUUCCUA UGCCUUAG | 74 | CUAAGGCA CUGAUGA X GAA AGGAAUUU | 897 |
| 542 | CUAUGCCUU AGCAGUCU | 75 | CCUGAUGA CUGAUGA X GAA AGGCAUAG | 898 |
| 543 | UAUGCCUUA GCAGUCUU | 76 | AAGACUGC CUGAUGA X GAA AAGGCAUA | 899 |
| 549 | UUAGCAGUC UUAUCUAA | 77 | UUAGAUAA CUGAUGA X GAA ACUGCUAA | 900 |
| 551 | AGCAGUCUU AUCUAACU | 78 | AGUUAGAU CUGAUGA X GAA AGACUGCU | 901 |
| 552 | GCAGUCUUA UCUAACUA | 79 | UAGUUAGA CUGAUGA X GAA AAGACUGC | 902 |
| 554 | AGUCUUAUC UAACUAUG | 80 | CAUAGUUA CUGAUGA X GAA AUAAGACU | 903 |
| 556 | UCUUAUCUA ACUAUGAU | 81 | AUCAUAGU CUGAUGA X GAA AGAUAAGA | 904 |
| 560 | AUCUAACUA UGAUGCAA | 82 | UUGCAUCA CUGAUGA X GAA AGUUAGAU | 905 |
| 571 | AUGCAAAUA AAACCGGA | 83 | UCCGGUUU CUGAUGA X GAA AUUUGCAU | 906 |
| 604 | UGAGAAAUU UACAGGAA | 84 | UUCCUGUA CUGAUGA X GAA AUUUCUCA | 907 |
| 605 | GAGAAAUUU ACAGGAAA | 85 | UUUCCUGU CUGAUGA X GAA AAUUUCUC | 908 |
| 606 | AGAAAUUUA CAGGAAAU | 86 | AUUUCCUG CUGAUGA X GAA AAAUUUCU | 909 |
| 615 | CAGGAAAUC CUGCAUGG | 87 | CCAUGCAG CUGAUGA X GAA AUUUCCUG | 910 |
| 635 | CGUGCGGUU CAGCAACA | 88 | UGUUGCUG CUGAUGA X GAA ACCGCACG | 911 |
| 636 | GUGCGGUUC AGCAACAA | 89 | UUGUUGCU CUGAUGA X GAA AACCGCAC | 912 |
| 672 | GAGAGCAUC CAGUGGCG | 90 | CGCCACUG CUGAUGA X GAA AUGCUCUC | 913 |
| 687 | CGGGACAUA GUCAGCAG | 91 | CUGCUGAC CUGAUGA X GAA AUGUCCCG | 914 |
| 690 | GACAUAGUC AGCAGUGA | 92 | UCACUGCU CUGAUGA X GAA ACUAUGUC | 915 |
| 701 | CAGUGACUU UCUCAGCA | 93 | UGCUGAGA CUGAUGA X GAA AGUCACUG | 916 |
| 702 | AGUGACUUU CUCAGCAU | 94 | UUGCUGAG CUGAUGA X GAA AAGUCACU | 917 |
| 703 | GUGACUUUC UCAGCAAC | 95 | GUUGCUGA CUGAUGA X GAA AAACUCAC | 918 |
| 705 | GACUUUCUC AGCAACAU | 96 | AUGUUGCU CUGAUGA X GAA AGAAAGUC | 919 |
| 716 | CAACAUGUC GAUGGACU | 97 | AGUCCAUC CUGAUGA X GAA ACAUGUUG | 920 |
| 725 | GAUGGACUU CCAGAACC | 98 | GGUUCUGG CUGAUGA X GAA AGUCCAUC | 921 |
| 726 | AUGGACUUC CAGAACCA | 99 | UGGUUCUG CUGAUGA X GAA AAGUCCAU | 922 |
| 760 | AGUGUGAUC CAAGCUGU | 100 | ACAGCUUG CUGAUGA X GAA AUCACACU | 923 |
| 769 | CAAGCUGUC CCAAUGGG | 101 | CCCAUUGG CUGAUGA X GAA ACAGCUUG | 924 |
| 825 | ACCAAAAUC AUCUGUGC | 102 | GCACAGAU CUGAUGA X GAA AUUUUGGU | 925 |
| 828 | AAAAUCAUC UGUGCCCA | 103 | UGGGCACA CUGAUGA X GAA AUGAUUUU | 926 |
| 845 | GCAGUGCUC CGGGCGCU | 104 | AGCGCCCG CUGAUGA X GAA AGCACUGC | 927 |

TABLE III-continued

Human EGF-R Hammerhead Ribozyme and Target Sequences

| nt. Position | Substrate | Seq. ID NOs. | Ribozyme | Seq. ID NOs. |
|---|---|---|---|---|
| 866 | UGGCAAGUC CCCCAGUG | 105 | CACUGGGG CUGAUGA X GAA ACUUGCCA | 928 |
| 936 | UGCCUGGUC UGCCGCAA | 106 | UUGCCGGCA CUGAUGA X GAA ACCAGGCA | 929 |
| 947 | CCGCAAAUU CCGAGACG | 107 | CGUCUCGG CUGAUGA X GAA AUUUGCGG | 930 |
| 948 | CGCAAAUUC CGAGACGA | 108 | UCGUCUCG CUGAUGA X GAA AAUUUGCG | 931 |
| 987 | CCCCCACUC AUGCUCUA | 109 | UAGAGCAU CUGAUGA X GAA AGUGGGGG | 932 |
| 993 | CUCAUGCUC UACAACCC | 110 | GGGUUGUA CUGAUGA X GAA AGCAUGAG | 933 |
| 995 | CAUGCUCUA CAACCCCA | 111 | UGGGGUUG CUGAUGA X GAA AGAGCAUG | 934 |
| 1010 | CACCACGUA CCAGAUGG | 112 | CCAUCUGG CUGAUGA X GAA ACGUGGUG | 935 |
| 1040 | GGGCAAAUA CAGCUUUG | 113 | CAAAGCUG CUGAUGA X GAA AUUUGCCC | 936 |
| 1046 | AUACAGCUU UGGUGCCA | 114 | UGGCACCA CUGAUGA X GAA AGCUGUAU | 937 |
| 1047 | UACAGCUUU GGUGCCAC | 115 | GUGGCACC CUGAUGA X GAA AAGCUGUA | 938 |
| 1072 | AGAAGUGUC CCCGUAAU | 116 | AUUACGGG CUGAUGA X GAA ACACUUCU | 939 |
| 1078 | GUCCCCGUA AUUAUGUG | 117 | CACAUAAU CUGAUGA X GAA ACGGGGAC | 940 |
| 1081 | CCCGUAAUU AUGUGGUG | 118 | CACCACAU CUGAUGA X GAA AUUACGGG | 941 |
| 1082 | CCGUAAUUA UGUGGUGA | 119 | UCACCACA CUGAUGA X GAA AAUUACGG | 942 |
| 1096 | UGACAGAUC ACGGCUCG | 120 | CGAGCCGU CUGAUGA X GAA AUCUGUCA | 943 |
| 1103 | UCACGGCUC GUGCGUCC | 121 | GGACGCAC CUGAUGA X GAA AGCCGUGA | 944 |
| 1110 | UCGUGCGUC CGAGCCUG | 122 | CAGGCUCG CUGAUGA X GAA ACGCACGA | 945 |
| 1133 | CGACAGCUA UGAGAUGG | 123 | CCAUCUCA CUGAUGA X GAA AGCUGUCG | 946 |
| 1155 | GACGGCGUC CGCAAGUG | 124 | CACUUGCG CUGAUGA X GAA ACGCCGUC | 947 |
| 1165 | GCAAGUGUA AGAAGUGC | 125 | GCACUUCU CUGAUGA X GAA ACACUUGC | 948 |
| 1183 | AAGGGCCUU GCCGCAAA | 126 | UUUGCGGC CUGAUGA X GAA AGGCCCUU | 949 |
| 1198 | AAGUGUGUA ACGGAAUA | 127 | UAUUCCGU CUGAUGA X GAA ACACACUU | 950 |
| 1206 | AACGGAAUA GGUAUUGG | 128 | CCAAUACC CUGAUGA X GAA AUUCCGUU | 951 |
| 1210 | GAAUAGGUA UUGGUGAA | 129 | UUCACCAA CUGAUGA X GAA ACCUAUUC | 952 |
| 1212 | AUAGGUAUU GGUGAAUU | 130 | AAUUCACC CUGAUGA X GAA AUACCUAU | 953 |
| 1220 | UGGUGAAUU UAAAGACU | 131 | AGUCUUUA CUGAUGA X GAA AUUCACCA | 954 |
| 1221 | GGUGAAUUU AAAGACUC | 132 | GAGUCUUU CUGAUGA X GAA AAUACACC | 955 |
| 1222 | GUGAAUUUA AAGACUCA | 133 | UGAGUCUU CUGAUGA X GAA AAAUUCAC | 956 |
| 1229 | UAAAGACUC ACUCUCCA | 134 | UGGAGAGU CUGAUGA X GAA AGUCUUUA | 957 |
| 1233 | GACUCACUC UCCAUAAA | 135 | UUUAUGGA CUGAUGA X GAA AGUGAGUC | 958 |
| 1235 | CUCACUCUC CAUAAAUG | 136 | CAUUUAUG CUGAUGA X GAA AGAGUGAG | 959 |
| 1239 | CUCUCCAUA AAUGCUAC | 137 | GUAGCAUU CUGAUGA X GAA AUGGAGAG | 960 |
| 1246 | UAAAUGCUA CGAAUAUU | 138 | AAUAUUCG CUGAUGA X GAA AGCAUUUA | 961 |
| 1252 | CUACGAAUA UUAAACAC | 139 | GUGUUUAA CUGAUGA X GAA AUUCGUAG | 962 |
| 1254 | ACGAAUAUU AAACACUU | 140 | AAGUGUUU CUGAUGA X GAA AUAUUCGU | 963 |
| 1255 | CGAAUAUUA AACACUUC | 141 | GAAGUGUU CUGAUGA X GAA AAUAUUCG | 964 |
| 1262 | UAAACACUU CAAAAACU | 142 | AGUUUUUG CUGAUGA X GAA AGUGUUUA | 965 |
| 1263 | AAACACUUC AAAAACUG | 143 | CAGUUUUU CUGAUGA X GAA AAGUGUUU | 966 |
| 1277 | CUGCACCUC CAUCAGUG | 144 | CACUGAUG CUGAUGA X GAA AGGUGCAG | 967 |
| 1281 | ACCUCCAUC AGUGGCGA | 145 | UCGCCACU CUGAUGA X GAA AUGGAGGU | 968 |
| 1291 | GUGGCGAUC UCCACAUC | 146 | GAUGUGGA CUGAUGA X GAA AUCGCCAC | 969 |
| 1293 | GGCGAUCUC CACAUCCU | 147 | AGGAUGUG CUGAUGA X GAA AGAUCGCC | 970 |
| 1299 | CUCCACAUC CUGCCGGU | 148 | ACCGGCAG CUGAUGA X GAA AUGUGGAG | 971 |
| 1313 | GGUGGCAUU UAGGGGUG | 149 | CACCCCUA CUGAUGA X GAA AUGCCACC | 972 |
| 1314 | GUGGCAUUU AGGGGUGA | 150 | UCACCCCU CUGAUGA X GAA AAUGCCAC | 973 |
| 1315 | UGGCAUUUA GGGGUGAC | 151 | GUCACCCC CUGAUGA X GAA AAAUGCCA | 974 |
| 1325 | GGGUGACUC CUUCACAC | 152 | GUGUGAAG CUGAUGA X GAA AGUCACCC | 975 |
| 1328 | UGACUCCUU CACACAUA | 153 | UAUGUGUG CUGAUGA X GAA AGGAGUCA | 976 |
| 1329 | GACUCCUUC ACACAUAC | 154 | GUAUGUGU CUGAUGA X GAA AAGGAGUC | 977 |
| 1336 | UCACACAUA CUCCUCCU | 155 | AGGAGGAG CUGAUGA X GAA AUGUGUGA | 978 |
| 1339 | CACAUACUC CUCCUCUG | 156 | CAGAGGAG CUGAUGA X GAA AGUAUGUG | 979 |
| 1342 | AUACUCCUC CUCUGGAU | 157 | AUCCAGAG CUGAUGA X GAA AGGAGUAU | 980 |
| 1345 | CUCCUCCUC UGGAUCCA | 158 | UGGAUCCA CUGAUGA X GAA AGGAGGAG | 981 |
| 1351 | CUCUGGAUC CACAGGAA | 159 | UUCCUGUG CUGAUGA X GAA AUCCAGAG | 982 |
| 1366 | AACUGGAUA UUCUGAAA | 160 | UUUCAGAA CUGAUGA X GAA AUCCAGUU | 983 |
| 1368 | CUGGAUAUU CUGAAAAC | 161 | GUUUUCAG CUGAUGA X GAA AUAUCCAG | 984 |
| 1369 | UGGAUAUUC UGAAAACC | 162 | GGUUUUCA CUGAUGA X GAA AAUAUCCA | 985 |
| 1380 | AAAACCGUA AAGGAAAU | 163 | AUUUCCUU CUGAUGA X GAA ACGGUUUU | 986 |
| 1389 | AAGGAAAUC ACAGGGUU | 164 | AACCCUGU CUGAUGA X GAA AUUUCCUU | 987 |
| 1397 | CACAGGGUU UUUGCUGA | 165 | UCAGCAAA CUGAUGA X GAA ACCCUGUG | 988 |
| 1398 | ACAGGGUUU UUGCUGAU | 166 | AUCAGCAA CUGAUGA X GAA AACCCUGU | 989 |
| 1399 | CAGGGUUUU UGCUGAUU | 167 | AAUCAGCA CUGAUGA X GAA AAACCCUG | 990 |
| 1400 | AGGGUUUUU GCUGAUUC | 168 | GAAUCAGC CUGAUGA X GAA AAAACCCU | 991 |
| 1407 | UUGCUGAUU CAGGCUUG | 169 | CAAGCCUG CUGAUGA X GAA AUCAGCAA | 992 |
| 1408 | UGCUGAUUC AGGCUUGG | 170 | CCAAGCCU CUGAUGA X GAA AAUCAGCA | 993 |
| 1414 | UUCAGGCUU GGCUGAA | 171 | UUCAGGCC CUGAUGA X GAA AGCCUGAA | 994 |
| 1437 | ACGGACCUC CAUGCCUU | 172 | AAGGCAUG CUGAUGA X GAA AGGUCCGU | 995 |
| 1445 | CCAUGCCUU UGAGAACC | 173 | GGUUCUCA CUGAUGA X GAA AAGGCAUG | 996 |
| 1446 | CAUGCCUUU GAGAACCU | 174 | AGGUUCUC CUGAUGA X GAA AAAGGCAUG | 997 |
| 1455 | GAGAACCUA GAAAUCAU | 175 | AUGAUUUC CUGAUGA X GAA AGGUUCUC | 998 |
| 1461 | CUAGAAAUC AUACGCGG | 176 | CCGCGUAU CUGAUGA X GAA AUUUCUAG | 999 |
| 1464 | GAAAUCAUA CGCGGCAG | 177 | CUGCCGCG CUGAUGA X GAA AUGAUUUC | 1000 |
| 1489 | AACAUGCUC AGUUUUCU | 178 | AGAAAACU CUGAUGA X GAA ACCAUGUU | 1001 |

TABLE III-continued

Human EGF-R Hammerhead Ribozyme and Target Sequences

| nt. Position | Substrate | Seq. ID NOs. | Ribozyme | Seq. ID NOs. |
|---|---|---|---|---|
| 1493 | UGGUCAGUU UUCUCUUG | 179 | CAAGAGAA CUGAUGA X GAA ACUGACCA | 1002 |
| 1494 | GGUCAGUUU UCUCUUGC | 180 | GCAAGAGA CUGAUGA X GAA AACUGACC | 1003 |
| 1495 | GUCAGUUUU CUCUUGCA | 181 | UGCAAGAG CUGAUGA X GAA AAACUGAC | 1004 |
| 1496 | UCAGUUUUC UCUUGCAG | 182 | CUGCAAGA CUGAUGA X GAA AAAACUGA | 1005 |
| 1498 | AGUUUUCUC UUGCAGUC | 183 | GACUGCAA CUGAUGA X GAA AGAAAACU | 1006 |
| 1500 | UUUUCUCUU GCAGUCGU | 184 | ACGACUGC CUGAUGA X GAA AGAGAAAA | 1007 |
| 1506 | CUUGCAGUC GUCAGCCU | 185 | AGGCUGAC CUGAUGA X GAA ACUGCAAG | 1008 |
| 1509 | GCAGUCGUC AGCCUGAA | 186 | UUCAGGCU CUGAUGA X GAA ACGACUGC | 1009 |
| 1521 | CUGAACAUA ACAUCCUU | 187 | AAGGAUGU CUGAUGA X GAA AUGUUCAG | 1010 |
| 1526 | CAUAACAUC CUUGGGAU | 188 | AUCCCAAG CUGAUGA X GAA AUGUUAUG | 1011 |
| 1529 | AACAUCCUU GGGAUUAC | 189 | GUAAUCCC CUGAUGA X GAA AGGAUGUU | 1012 |
| 1535 | CUUGGGAUU ACGCUCCC | 190 | GGGAGCGU CUGAUGA X GAA AUCCCAAG | 1013 |
| 1536 | UUGGGAUUA CGCUCCCU | 191 | AGGGAGCG CUGAUGA X GAA AAUCCCAA | 1014 |
| 1541 | AUUACGCUC CCUCAAGG | 192 | CCUUGAGG CUGAUGA X GAA AGCGUAAU | 1015 |
| 1545 | CGCUCCCUC AAGGAGAU | 193 | AUCUCCUU CUGAUGA X GAA AGGGAGCG | 1016 |
| 1554 | AAGGAGAUA AGUGAUGG | 194 | CCAUCACU CUGAUGA X GAA AUCUCCUU | 1017 |
| 1572 | GAUGUGAUA AUUUCAGG | 195 | CCUGAAAU CUGAUGA X GAA AUCACAUC | 1018 |
| 1575 | GUGAUAAUU UCAGGAAA | 196 | UUUCCUGA CUGAUGA X GAA AAUUAUCA | 1019 |
| 1576 | UGAUAAUUU CAGGAAAC | 197 | GUUUCCUG CUGAUGA X GAA AAUUAUCA | 1020 |
| 1577 | GAUAAUUUC AGGAAACA | 198 | UGUUUCCU CUGAUGA X GAA AAAUUAUC | 1021 |
| 1591 | ACAAAAAUU UGUGCUAU | 199 | AUAGCACA CUGAUGA X GAA AUUUUUGU | 1022 |
| 1592 | CAAAAAUUU GUGCUAUG | 200 | CAUAGCAC CUGAUGA X GAA AAUUUUUG | 1023 |
| 1598 | UUUGUGCUA UGCAAAUA | 201 | UAUUUGCA CUGAUGA X GAA AGCACAAA | 1024 |
| 1606 | AUGCAAAUA CAAUAAAC | 202 | GUUUAUUG CUGAUGA X GAA AUUUGCAU | 1025 |
| 1611 | AAUACAAUA AACUGGAA | 203 | UUCCAGUU CUGAUGA X GAA AUUGUAUU | 1026 |
| 1628 | AAAACUGUU UGGGACCU | 204 | AGGUCCCA CUGAUGA X GAA ACAGUUUU | 1027 |
| 1629 | AAACUGUUU GGGACCUC | 205 | GAGGUCCC CUGAUGA X GAA AACAGUUU | 1028 |
| 1637 | UGGGACCUC CGGUCAGA | 206 | UCUGACCG CUGAUGA X GAA AGGUCCCA | 1029 |
| 1642 | CCUCCGGUC AGAAAACC | 207 | GGUUUUCU CUGAUGA X GAA ACCGGAGG | 1030 |
| 1656 | ACCAAAAUU AUAAGCAA | 208 | UUGCUUAU CUGAUGA X GAA AUUUUGGU | 1031 |
| 1657 | CCAAAAUUA UAAGCAAC | 209 | GUUGCUUA CUGAUGA X GAA AAUUUUGG | 1032 |
| 1659 | AAAAUUAUA AGCAACAG | 210 | CUGUUGCU CUGAUGA X GAA AUAAUUUU | 1033 |
| 1701 | GGCCAGGUC UGCCAUGC | 211 | GCAUGGCA CUGAUGA X GAA ACCUGGCC | 1034 |
| 1712 | CCAUGCCUU GUGCUCCC | 212 | GGGAGCAC CUGAUGA X GAA AGGCAUGG | 1035 |
| 1718 | CUUGUGCUC CCCGAGG | 213 | CCUCGGGG CUGAUGA X GAA AGCACAAG | 1036 |
| 1758 | GACUGCGUC UCUUGCCG | 214 | CGGCAAGA CUGAUGA X GAA ACGCAGUC | 1037 |
| 1760 | CUGCGUCUC UUGCCGGA | 215 | UCCGGCAA CUGAUGA X GAA AGACGCAG | 1038 |
| 1762 | GCGUCUCUU GCCGGAAU | 216 | AUUCCGGC CUGAUGA X GAA AGAGACGC | 1039 |
| 1773 | CGGAAUGUC AGCCGAGG | 217 | CCUCGGCU CUGAUGA X GAA ACAUUCCG | 1040 |
| 1809 | UGCAAGCUU CUGGAGGG | 218 | CCCUCCAG CUGAUGA X GAA AGCUUGCA | 1041 |
| 1810 | GCAAGCUUC UGGAGGGU | 219 | ACCCUCCA CUGAUGA X GAA AAGCUUGC | 1042 |
| 1832 | AAGGGAGUU GUGGAGA | 220 | UCUCCACA CUGAUGA X GAA ACUCCCUU | 1043 |
| 1833 | AGGGAGUUU GUGGAGAA | 221 | UUCUCCAC CUGAUGA X GAA AACUCCCU | 1044 |
| 1844 | GGAGAACUC UGAGUGCA | 222 | UGCACUCA CUGAUGA X GAA AGUUCUCC | 1045 |
| 1854 | GAGUGCAUA CAGUGCCA | 223 | UGGCACUG CUGAUGA X GAA AUGCACUC | 1046 |
| 1879 | GCCUGCCUC AGGCCAUG | 224 | CAUGGCCU CUGAUGA X GAA AGGCAGGC | 1047 |
| 1893 | AUGAACAUC ACCUGCAC | 225 | GUGCAGGU CUGAUGA X GAA AUGUUCAU | 1048 |
| 1924 | ACAACUGUA UCCAGUGU | 226 | ACACUGGA CUGAUGA X GAA ACAGUUGU | 1049 |
| 1926 | AACUGUAUC CAGUGUGC | 227 | GCACACUG CUGAUGA X GAA AUACAGUU | 1050 |
| 1940 | UGCCCACUA CAUUGACG | 228 | CGUCAAUG CUGAUGA X GAA AGUGGGCA | 1051 |
| 1944 | CACUACAUU GACGGCCC | 229 | GGGCCGUC CUGAUGA X GAA AUGUAGUG | 1052 |
| 1962 | CACUGCGUC AAGACCUG | 230 | CAGGUCUU CUGAUGA X GAA ACGCAGUG | 1053 |
| 1983 | GCAGGAGUC AUGGGAGA | 231 | UCUCCCAU CUGAUGA X GAA ACUCCUGC | 1054 |
| 2007 | ACCCUGGUC UGGAAGUA | 232 | UACUUCCA CUGAUGA X GAA ACCAGGGU | 1055 |
| 2015 | CUGGAAGUA CGCAGACG | 233 | CGUCUGCG CUGAUGA X GAA ACUUCCAG | 1056 |
| 2050 | UGUGCCAUC CAAACUGC | 234 | GCAGUUUG CUGAUGA X GAA AUGGCACA | 1057 |
| 2063 | CUGCACCUA CGGAUGCA | 235 | UGCAUCCG CUGAUGA X GAA AGGUGCAG | 1058 |
| 2083 | GGCCAGGUC UUGAAGGC | 236 | GCCUUCAA CUGAUGA X GAA ACCUGGCC | 1059 |
| 2085 | CCAGGUCUU GAAGGCUG | 237 | CAGCCUUC CUGAUGA X GAA AGACCUGG | 1060 |
| 2095 | AAGGCUGUC CAACGAAU | 238 | AUUCGUUG CUGAUGA X GAA ACAGCCUU | 1061 |
| 2110 | AUGGGCCUA AGAUCCCG | 239 | CGGGAUCU CUGAUGA X GAA AGGCCCAU | 1062 |
| 2115 | CCUAAGAUC CCGUCCAU | 240 | AUGGACGG CUGAUGA X GAA AUCUUAGG | 1063 |
| 2120 | GAUCCCGUC CAUCGCCA | 241 | UGGCGAUG CUGAUGA X GAA ACGGGAUC | 1064 |
| 2124 | CCGUCCAUC GCCACGGG | 242 | CCAGUGGC CUGAUGA X GAA AUGGACGG | 1065 |
| 2148 | GGGGCCCUC CUCUUGCU | 243 | AGCAAGAG CUGAUGA X GAA AGGGCCCC | 1066 |
| 2151 | GCCCUCCUC UUGCUGCU | 244 | AGCAGCAA CUGAUGA X GAA AGGAGGGC | 1067 |
| 2153 | CCUCCUCUU GCUGCUGG | 245 | CCAGCAGC CUGAUGA X GAA AGAGGAGG | 1068 |
| 2178 | CUGGGGAUC GGCCUCUU | 246 | AAGAGGCC CUGAUGA X GAA AUCCCCAG | 1069 |
| 2184 | AUCGGCCUC UUCAUGCC | 247 | GGCAUGAA CUGAUGA X GAA AGGCCGAU | 1070 |
| 2186 | CGGCCUCUU CAUGCGAA | 248 | UUCGCAUG CUGAUGA X GAA AGAGGCCG | 1071 |
| 2187 | GGCCUCUUC AUGCGAAG | 249 | CUUCGCAU CUGAUGA X GAA AAGAGGCC | 1072 |
| 2205 | CGCCACAUC GUUCGGAA | 250 | UUCCGAAC CUGAUGA X GAA AUGUGGCG | 1073 |
| 2208 | CACAUCGUU CGGAAGCG | 251 | CGCUUCCG CUGAUGA X GAA ACGAUGUG | 1074 |
| 2209 | ACAUCGUUC GGAAGCGC | 252 | GCGCUUCC CUGAUGA X GAA AACGAUGU | 1075 |

TABLE III-continued

Human EGF-R Hammerhead Ribozyme and Target Sequences

| nt. Position | Substrate | Seq. ID NOs. | Ribozyme | Seq. ID NOs. |
|---|---|---|---|---|
| 2250 | AGGGAGCUU GUGGAGCC | 253 | GGCUCCAC CUGAUGA X GAA AGCUCCCU | 1076 |
| 2260 | UGGAGCCUC UUACACCC | 254 | GGGUGUAA CUGAUGA X GAA AGGCUCCA | 1077 |
| 2262 | GAGCCUCUU ACACCCAG | 255 | CUGGGUGU CUGAUGA X GAA AGAGGCUC | 1078 |
| 2263 | AGCCUCUUA CACCCAGU | 256 | ACUGGGUG CUGAUGA X GAA AAGAGGCU | 1079 |
| 2281 | GAGAAGCUC CCAACCAA | 257 | UUGGUUGG CUGAUGA X GAA AGCUUCUC | 1080 |
| 2293 | ACCAAGCUC UCUUGAGG | 258 | CCUCAAGA CUGAUGA X GAA AGCUUGGU | 1081 |
| 2295 | CAAGCUCUC UUGAGGAU | 259 | AUCCUCAA CUGAUGA X GAA AGAGCUUG | 1082 |
| 2297 | AGCUCUCUU GAGGAUCU | 260 | AGAUCCUC CUGAUGA X GAA AGAGAGCU | 1083 |
| 2304 | UUGAGGAUC UUGAAGGA | 261 | UCCUUCAA CUGAUGA X GAA AUCCUCAA | 1084 |
| 2306 | GAGGAUCUU GAAGGAAA | 262 | UUUCCUUC CUGAUGA X GAA AGGAUCCU | 1085 |
| 2321 | AACUGAAUU CAAAAAGA | 263 | UCUUUUUG CUGAUGA X GAA AUUCAGUU | 1086 |
| 2322 | ACUGAAUUC AAAAAGAU | 264 | AUCUUUUU CUGAUGA X GAA AAUUCAGU | 1087 |
| 2331 | AAAAAGAUC AAAGUGCU | 265 | AGCACUUU CUGAUGA X GAA AUCUUUUU | 1088 |
| 2345 | GCUGGGCUC CGGUGCGU | 266 | ACGCACCG CUGAUGA X GAA AGCCCAGC | 1089 |
| 2354 | CGGUGCGUU CGGCACGG | 267 | CCGUGCCG CUGAUGA X GAA ACGCACCG | 1090 |
| 2355 | GGUGCGUUC GGCACGGU | 268 | ACCGUGCC CUGAUGA X GAA AACGCACC | 1091 |
| 2366 | CACGGUGUA UAAGGGAC | 269 | GUCCCUUA CUGAUGA X GAA ACACCGUG | 1092 |
| 2368 | CGGUGUAUA AGGGACUC | 270 | GAGUCCCU CUGAUGA X GAA AUACACCG | 1093 |
| 2376 | AAGGGACUC UGGAUCCC | 271 | GGGAUCCA CUGAUGA X GAA AGUCCCUU | 1094 |
| 2382 | CUCUGGAUC CCAGAAGG | 272 | CCUUCUGG CUGAUGA X GAA AUCCAGAG | 1095 |
| 2400 | GAGAAAGUU AAAAUUCC | 273 | GGAAUUUU CUGAUGA X GAA ACUUUCUC | 1096 |
| 2401 | AGAAAGUUA AAAUUCCC | 274 | GGGAAUUU CUGAUGA X GAA AACUUUCU | 1097 |
| 2406 | GUUAAAAUU CCCGUCGC | 275 | GCGACGGG CUGAUGA X GAA AUUUUAAC | 1098 |
| 2407 | UUAAAAUUC CCGUCGCU | 276 | AGCGACGG CUGAUGA X GAA AAUUUUAA | 1099 |
| 2412 | AUUCCCGUC GCUAUCAA | 277 | UUGAUAGC CUGAUGA X GAA ACGGGAAU | 1100 |
| 2416 | CCGUCGCUA UCAAGGAA | 278 | UUCCUUGA CUGAUGA X GAA AGCGACGG | 1101 |
| 2418 | GUCGCUAUC AAGGAAUU | 279 | AAUUCCUU CUGAUGA X GAA AUAGCGAC | 1102 |
| 2426 | CAAGGAAUU AAGAGAAG | 280 | CUUCUCUU CUGAUGA X GAA AUUCCUUG | 1103 |
| 2427 | AAGGAAUUA AGAGAAGC | 281 | GCUUCUCU CUGAUGA X GAA AAUUCCUU | 1104 |
| 2441 | AGCAACAUC UCCGAAAG | 282 | CUUUCGGA CUGAUGA X GAA AUGUUGCU | 1105 |
| 2443 | CAACAUCUC CGAAAGCC | 283 | GGCUUUCG CUGAUGA X GAA AGAUGUUG | 1106 |
| 2463 | AAGGAAAUC CUCGAUGA | 284 | UCAUCGAG CUGAUGA X GAA AUUUCCUU | 1107 |
| 2466 | GAAAUCCUC GAUGAAGC | 285 | GCUUCAUC CUGAUGA X GAA AGGAUUUC | 1108 |
| 2477 | UGAAGCCUA CGUGAUGG | 286 | CCAUCACG CUGAUGA X GAA AGGCUUCA | 1109 |
| 2526 | CUGGGCAUC UGCCUCAC | 287 | GUGAGGCA CUGAUGA X GAA AUGCCCAG | 1110 |
| 2532 | AUCUGCCUC ACCUCCAC | 288 | GUGGAGGU CUGAUGA X GAA AGGCAGAU | 1111 |
| 2537 | CCUCACCUC CACCGUGC | 289 | GCACGGUG CUGAUGA X GAA AGGUGAGG | 1112 |
| 2550 | GUGCAACUC AUCACGCA | 290 | UGCGUGAU CUGAUGA X GAA AGUUGCAC | 1113 |
| 2553 | CAACUCAUC ACGCAGCU | 291 | AGCUGCGU CUGAUGA X GAA AUGAGUUG | 1114 |
| 2562 | ACGCAGCUC AUGCCCUU | 292 | AAGGGCAU CUGAUGA X GAA AGCUGCGU | 1115 |
| 2570 | CAUGCCCUU CGGCUGCC | 293 | GGCAGCCG CUGAUGA X GAA AGGGCAUG | 1116 |
| 2571 | AUGCCCUUC GGCUGCCU | 294 | AGGCAGCC CUGAUGA X GAA AAGGGCAU | 1117 |
| 2580 | GGCUGCCUC CUGGACUA | 295 | UAGUCCAG CUGAUGA X GAA AGGCAGCC | 1118 |
| 2588 | CCUGGACUA UGUCCGGG | 296 | CCCGGACA CUGAUGA X GAA AGUCCAGG | 1119 |
| 2592 | GACUAUGUC CGGGAACA | 297 | UGUUCCCG CUGAUGA X GAA ACAUAGUC | 1120 |
| 2611 | AAGACAAUA UUGGCUCC | 298 | GGAGCCAA CUGAUGA X GAA AUUGUCUU | 1121 |
| 2613 | GACAAUAUU GGCUCCCA | 299 | UGGGAGCC CUGAUGA X GAA AUAUUGUC | 1122 |
| 2618 | UAUUGGCUC CCAGUAAC | 300 | GGUACUGG CUGAUGA X GAA AGCCAAUA | 1123 |
| 2624 | CUCCCAGUA CCUGCUCA | 301 | UGAGCAGG CUGAUGA X GAA ACUGGGAG | 1124 |
| 2631 | UACCUGCUC AACUGGUG | 302 | CACCAGUU CUGAUGA X GAA AGCAGGUA | 1125 |
| 2649 | GUGCAGAUC GCAAAGGG | 303 | CCCUUUGC CUGAUGA X GAA AUCUGCAC | 1126 |
| 2666 | CAUGAACUA CUUGGAGG | 304 | CCUCCAAG CUGAUGA X GAA AGUUCAUG | 1127 |
| 2669 | GAACUACUU GGAGGACC | 305 | GGUCCUCC CUGAUGA X GAA AGUAGUUC | 1128 |
| 2680 | AGGACCGUU GCUGGGUG | 306 | CACCAAGC CUGAUGA X GAA ACGGUCCU | 1129 |
| 2684 | CCGUCGCUU GGUGCACC | 307 | GGUGCACC CUGAUGA X GAA AGCGACGG | 1130 |
| 2715 | AGGAACGUA CUGGUGAA | 308 | UUCACCAG CUGAUGA X GAA ACGUUCCU | 1131 |
| 2739 | CAGCAUGUC AAGAUCAC | 309 | GUGAUCUU CUGAUGA X GAA ACAUGCUG | 1132 |
| 2745 | GUCAAGAUC ACAGAUUU | 310 | AAAUCUGU CUGAUGA X GAA AUCUUGAC | 1133 |
| 2752 | UCACAGAUU UGGGCUG | 311 | CAGCCCAA CUGAUGA X GAA AUCUGUGA | 1134 |
| 2753 | CACAGAUUU GGGCUGG | 312 | CCAGCCCA CUGAUGA X GAA AAUCUGUG | 1135 |
| 2754 | ACAGAUUUU GGGCUGGC | 313 | GCCAGCCC CUGAUGA X GAA AAAUCUGU | 1136 |
| 2792 | GAAAGAAUA CCAUGCAG | 314 | CUGCAUGG CUGAUGA X GAA AUUCUUUC | 1137 |
| 2818 | AAGUGCCUA UCAAGUGG | 315 | CCACUUGA CUGAUGA X GAA AGGCACUU | 1138 |
| 2820 | GUGCCUAUC AAGUGGAU | 316 | AUCCACUU CUGAUGA X GAA AUAGGCAC | 1139 |
| 2834 | GAUGGCAUU GGAAUCAA | 317 | UUGAUUCC CUGAUGA X GAA AUGCCAUC | 1140 |
| 2840 | AUUGGAAUC AAUUUUAC | 318 | GUAAAAUU CUGAUGA X GAA AUUCCAAU | 1141 |
| 2844 | GAAUCAAUU UUACACAG | 319 | CUGUGUAA CUGAUGA X GAA AAUUGAUUC | 1142 |
| 2845 | AAUCAAUUU UACACAGA | 320 | UCUGUGUA CUGAUGA X GAA AAUUGAUU | 1143 |
| 2846 | AUCAAUUUU ACACAGAA | 321 | UUCUGUGU CUGAUGA X GAA AAAUUGAU | 1144 |
| 2847 | UCAAUUUUA CACAGAAU | 322 | AUUCUGUG CUGAUGA X GAA AAAAUUGA | 1145 |
| 2856 | CACAGAAUC UAUACCCA | 323 | UGGGUAUA CUGAUGA X GAA AUUCUGUG | 1146 |
| 2858 | CAGAAUCUA UACCCACC | 324 | GGUGGGUA CUGAUGA X GAA AGAUUCUG | 1147 |
| 2860 | GAAUCUAUA CCCACCAG | 325 | CUGGUGGG CUGAUGA X GAA AUAGAUUC | 1148 |
| 2877 | AGUGAUGUC UGGAGCUA | 326 | UAGCUCCA CUGAUGA X GAA ACAUCACU | 1149 |

TABLE III-continued

Human EGF-R Hammerhead Ribozyme and Target Sequences

| nt. Position | Substrate | Seq. ID NOs. | Ribozyme | Seq. ID NOs. |
|---|---|---|---|---|
| 2885 | CUGGAGCUA CGGGGUGA | 327 | UCACCCCG CUGAUGA X GAA AGCUCCAG | 1150 |
| 2898 | GUGACCGUU UGGGAGUU | 328 | AACUCCCA CUGAUGA X GAA ACGGUCA | 1151 |
| 2899 | UGACCGUUU GGGAGUUG | 329 | CAACUCCC CUGAUGA X GAA AACGGUCA | 1152 |
| 2906 | UUGGGAGUU GAUGACCU | 330 | AGGUCAUC CUGAUGA X GAA ACUCCCAA | 1153 |
| 2915 | GAUGACCUU UGGAUCCA | 331 | UGGAUCCA CUGAUGA X GAA AGGUCAUC | 1154 |
| 2916 | AUGACCUUU GGAUCCAA | 332 | UUGGAUCC CUGAUGA X GAA AAGGUCAU | 1155 |
| 2921 | CUUUGGAUC CAAGCCAU | 333 | AUGGCUUG CUGAUGA X GAA AUCCAAAG | 1156 |
| 2930 | GAAGCCAUA UGACGGAA | 334 | UUCCGUCA CUGAUGA X GAA AUGGCUUG | 1157 |
| 2940 | GACGGAAUC CUGCCAG | 335 | CUGGCAGG CUGAUGA X GAA AUUCCGUC | 1158 |
| 2955 | AGCGAGAUC UCCUCGCU | 336 | AUGGAGGA CUGAUGA X GAA AGCGCUUC | 1159 |
| 2957 | CGAGAUCUC CUCCAUCC | 337 | GGAUGGAG CUGAUGA X GAA AGAUCUCG | 1160 |
| 2960 | GAUCUCCUC CAUCCUGG | 338 | CCAGGAUG CUGAUGA X GAA AGGAGAUC | 1161 |
| 2964 | UCCUCCAUC CUGGAGAA | 339 | UUCUCCAG CUGAUGA X GAA AUGGAGGA | 1162 |
| 2985 | GAACGCCUC CCUCAGCC | 340 | GGCUGAGG CUGAUGA X GAA AGGCGUUC | 1163 |
| 2989 | GCCUCCCUC AGCCACCC | 341 | GGGUGGCU CUGAUGA X GAA AGGGAGGC | 1164 |
| 3000 | CCACCCAUA UGUACCAU | 342 | AUGGUACA CUGAUGA X GAA AUGGGUGG | 1165 |
| 3004 | CCAUAUGUA CCAUCGAU | 343 | AUCGAUGG CUGAUGA X GAA ACAUAUGG | 1166 |
| 3009 | UGUACCAUC GAUGUCUA | 344 | UAGACAUC CUGAUGA X GAA AUGGUACA | 1167 |
| 3015 | AUCGAUGUC UACAUGAU | 345 | AUCAUGUA CUGAUGA X GAA ACAUCGAU | 1168 |
| 3017 | CGAUGUCUA CAUGAUCA | 346 | UGAUCAUG CUGAUGA X GAA AGACAUCG | 1169 |
| 3024 | UACAUGAUC AUGGUCAA | 347 | UUGACCAU CUGAUGA X GAA AUCAUGUA | 1170 |
| 3030 | AUCAUGGUC AAGUGCUG | 348 | CAGCACUU CUGAUGA X GAA ACCAUGAU | 1171 |
| 3045 | UGGAUGAUA GACGCAGA | 349 | UCUGCGUC CUGAUGA X GAA AUAUCACCA | 1172 |
| 3055 | ACGCAGAUA GUCGCCCA | 350 | UGGGCGAC CUGAUGA X GAA AUCUGCGU | 1173 |
| 3058 | CAGAUAGUC GCCCAAAG | 351 | CUUUGGGC CUGAUGA X GAA ACUAUCUG | 1174 |
| 3068 | CCCAAAGUU CCGUGAGU | 352 | ACUCACGG CUGAUGA X GAA ACUUUGGG | 1175 |
| 3069 | CCAAAGUUC CGUGAGUU | 353 | AACUCACG CUGAUGA X GAA AACUUUGG | 1176 |
| 3077 | CCCUGAGUU GAUCACG | 354 | CGAUGAUC CUGAUGA X GAA ACUCACGG | 1177 |
| 3081 | GAGUUGAUC AUCGAAUU | 355 | AAUUCGAU CUGAUGA X GAA AUCAACUC | 1178 |
| 3084 | UUGAUCAUC GAAUUCUC | 356 | GAGAAUUC CUGAUGA X GAA AUGAUCAA | 1179 |
| 3089 | CAUCGAAUU CUCCAAAA | 357 | UUUUGGAG CUGAUGA X GAA AUUCGAUG | 1180 |
| 3090 | AUCGAAUUC UCCAAAAU | 358 | AUUUUGGA CUGAUGA X GAA AAUUCGAU | 1181 |
| 3092 | CGAAUUCUC CAAAAUGG | 359 | CCAUUUUG CUGAUGA X GAA AGAGUUCG | 1182 |
| 3119 | CCAGCGCUA CCUUGUCA | 360 | UGACAAGG CUGAUGA X GAA AGCGCUGG | 1183 |
| 3123 | CGCUACCUU GUCAUUCA | 361 | UGAAUGAC CUGAUGA X GAA AGGUAGCG | 1184 |
| 3126 | UACCUUGUC AUUCAGGG | 362 | CCCUGAAU CUGAUGA X GAA ACAAGGUA | 1185 |
| 3129 | CUUGUCAUU CAGGGGGA | 363 | UCCCCCUG CUGAUGA X GAA AUGACAAG | 1186 |
| 3130 | UUGUCAUUC AGGGGGAU | 364 | AUCCCCCU CUGAUGA X GAA AAUGACAA | 1187 |
| 3151 | GAAUGCAUU UGCCAAGU | 365 | ACUUGGCA CUGAUGA X GAA AAUGCAUU | 1188 |
| 3152 | AAUGCAUUU GCCAAGUC | 366 | GACUUGGC CUGAUGA X GAA AAUGCAUU | 1189 |
| 3160 | UGCCAAGUC CUACAGAC | 367 | GUCUGUAG CUGAUGA X GAA ACUUGGCA | 1190 |
| 3163 | CAAGUCCUA CAGACUCC | 368 | GGAGUCUG CUGAUGA X GAA AGGACUUG | 1191 |
| 3170 | UACAGACUC CAACUUCU | 369 | AGAAGUUG CUGAUGA X GAA AGUCUGUA | 1192 |
| 3176 | CUCCAACUU CUACCCUG | 370 | CACGGUAG CUGAUGA X GAA AGUUGGAG | 1193 |
| 3177 | UCCAACUUC UACCGUGC | 371 | GCACGGUA CUGAUGA X GAA AAGUUGGA | 1194 |
| 3179 | CAACUUCUA CCGUGCCC | 372 | GGGCACGG CUGAUGA X GAA AGAAGUUG | 1195 |
| 3233 | CGACGAGUA CCUCAUCC | 373 | GGAUGAGG CUGAUGA X GAA ACUCGUCG | 1196 |
| 3237 | GAGUACCUC AUCCCACA | 374 | UGUGGGAU CUGAUGA X GAA AGGUACUC | 1197 |
| 3240 | UACCUCAUC CCACAGCA | 375 | UGCUGUGG CUGAUGA X GAA AUGAGGUA | 1198 |
| 3254 | GCAGGGCUU CUUCAGCA | 376 | UGCUGAAG CUGAUGA X GAA AGCCCUGC | 1199 |
| 3255 | CAGGGCUUC UUCAGCAG | 377 | CUGCUGAA CUGAUGA X GAA AAGCCCUG | 1200 |
| 3257 | GGGCUUCUU CAGCAGCC | 378 | GGCUGCUG CUGAUGA X GAA AAGAAGCC | 1201 |
| 3258 | GGCUUCUUC AGCAGCCC | 379 | GGGCUGCU CUGAUGA X GAA AAGAAGCC | 1202 |
| 3269 | CAGCCCCUC CACGUCAC | 380 | GUGACGUG CUGAUGA X GAA AGGGGCUG | 1203 |
| 3275 | CUCCACGUC ACGGACUC | 381 | GAGUCCGU CUGAUGA X GAA ACGUGGAG | 1204 |
| 3283 | CACGGACUC CCCUCCUG | 382 | CAGGAGGG CUGAUGA X GAA AGUCCGUG | 1205 |
| 3288 | ACUCCCCUC CUGAGCUC | 383 | GAGCUCAG CUGAUGA X GAA AGGGGAGU | 1206 |
| 3296 | CCUGAGCUC UCUGAGUG | 384 | CACUCAGA CUGAUGA X GAA AGCUCAGG | 1207 |
| 3298 | UGAGCUCUC UGAGUGCA | 385 | UGCACUCA CUGAUGA X GAA AGAGCUCA | 1208 |
| 3319 | GCAACAAUU CCACCGUG | 386 | CACGGUGG CUGAUGA X GAA AUUGAAGC | 1209 |
| 3320 | CAACAAUUC CACCGUGG | 387 | CCACGGUG CUGAUGA X GAA AAUUGUUG | 1210 |
| 3331 | CCGUGGCUU GCAUUGAU | 388 | AUCAAUGC CUGAUGA X GAA AGCCACGG | 1211 |
| 3336 | GCUUGCAUU GAUAGAAA | 389 | UUUCUAUC CUGAUGA X GAA AUGCAAGC | 1212 |
| 3340 | GCAUUGAUA GAAAUGGC | 390 | CCCAUUUC CUGAUGA X GAA AUCAAUGC | 1213 |
| 3361 | AAAGCUGUC CAUCAAG | 391 | CUUGAUGG CUGAUGA X GAA ACAGCUUU | 1214 |
| 3366 | UGUCCCAUC AAGGAAGA | 392 | UCUUCCUU CUGAUGA X GAA AUGGGACA | 1215 |
| 3380 | AGACAGCUU CUUGCAGC | 393 | GCUGCAAG CUGAUGA X GAA AGCUGUCU | 1216 |
| 3381 | GACAGCUUC UUGCAGCG | 394 | CGCUGCAA CUGAUGA X GAA AAGCUGUC | 1217 |
| 3383 | CAGCUUCUU GCAGCGAU | 395 | AUCGCUGC CUGAUGA X GAA AGAAGCUG | 1218 |
| 3392 | GCAGCGAUA CAGCUCAG | 396 | CUGAGCUG CUGAUGA X GAA AUCGCUGC | 1219 |
| 3398 | AUACAGCUC AGACCCCA | 397 | UGGGGUCU CUGAUGA X GAA AGCUGUAU | 1220 |
| 3416 | AGGCGCCUU GACUGAGG | 398 | CCUCAGUC CUGAUGA X GAA AGGCGCCU | 1221 |
| 3432 | GACACAUA GACGACAC | 399 | GUGUCGUC CUGAUGA X GAA AUGCUGUC | 1222 |
| 3443 | CGACACCUU CCUCCCAG | 400 | CUGGGAGG CUGAUGA X GAA AGGUGUCG | 1223 |

TABLE III-continued

Human EGF-R Hammerhead Ribozyme and Target Sequences

| nt. Position | Substrate | Seq. ID NOs. | Ribozyme | Seq. ID NOs. |
|---|---|---|---|---|
| 3444 | GACACCUUC CUCCCAGU | 401 | ACUGGGAG CUGAUGA X GAA AAGGUGUC | 1224 |
| 3447 | ACCUUCCUC CCAGUGCC | 402 | GGCACUGG CUGAUGA X GAA AGGAAGGU | 1225 |
| 3461 | GCCUGAAUA CAUAAACC | 403 | GGUUUAUG CUGAUGA X GAA AUUCAGGC | 1226 |
| 3465 | GAAUACAUA AACCAGUC | 404 | GACUGGUU CUGAUGA X GAA AUGUAUUC | 1227 |
| 3473 | AAACCAGUC CGUUCCCA | 405 | UGGGAACG CUGAUGA X GAA ACUGGUUU | 1228 |
| 3477 | CAGUCCGUU CCCAAAAG | 406 | CUUUUGGG CUGAUGA X GAA ACGGACUG | 1229 |
| 3478 | AGUCCGUUC CCAAAAGG | 407 | CCUUUUGG CUGAUGA X GAA AACGGACU | 1230 |
| 3497 | CGCUGGCUC UGUGCAGA | 408 | UCUGCACA CUGAUGA X GAA AGCCAGCG | 1231 |
| 3508 | UGCAGAAUC CUGUCUAU | 409 | AUAGACAG CUGAUGA X GAA AUUCUGCA | 1232 |
| 3513 | AAUCCUGUC UAUCACAA | 410 | UUGUGAUA CUGAUGA X GAA ACAGGAUU | 1233 |
| 3515 | UCCUGUCUA UCACAAUC | 411 | GAUUGUGA CUGAUGA X GAA AGACAGGA | 1234 |
| 3517 | CUGUCUAUC ACAAUCAG | 412 | CUGAUUGU CUGAUGA X GAA AUAGACAG | 1235 |
| 3523 | AUCACAAUC AGCCUCUG | 413 | CAGAGGCU CUGAUGA X GAA AUUGUGAU | 1236 |
| 3529 | AUCAGCCUC UGAACCCC | 414 | GGGCUUCA CUGAUGA X GAA AGGCUGAU | 1237 |
| 3560 | CCCACACUA CCAGGACC | 415 | GGUCCUGG CUGAUGA X GAA AGUGUGGG | 1238 |
| 3599 | CCCCGAGUA UCUCAACA | 416 | UGUUGAGA CUGAUGA X GAA ACUCGGGG | 1239 |
| 3601 | CCGAGUAUC UCAACACU | 417 | AGUGUUGA CUGAUGA X GAA AUACUCGG | 1240 |
| 3603 | GAGUAUCUC AACACUGU | 418 | ACAGUGUU CUGAUGA X GAA AGAUACUC | 1241 |
| 3612 | AACACUGUC CAGCCCAC | 419 | GUGGGCUG CUGAUGA X GAA ACAGUGUU | 1242 |
| 3627 | ACCUGUGUC AACAGCAC | 420 | GUGCUGUU CUGAUGA X GAA ACACAGGU | 1243 |
| 3638 | CAGCACAUU CGACAGCC | 421 | GGCUGUCG CUGAUGA X GAA AUGUGCUG | 1244 |
| 3639 | AGCACAUUC GACAGCCC | 422 | GGGCUGUC CUGAUGA X GAA AAUGUGCU | 1245 |
| 3681 | CACCAAAUU AGCCUGGA | 423 | UCCAGGCU CUGAUGA X GAA AUUUGGUG | 1246 |
| 3682 | ACCAAAUUA GCCUGGAC | 424 | GUCCAGGC CUGAUGA X GAA AAUUUGGU | 1247 |
| 3731 | CCCUGACUA CCAGCAGG | 425 | CCUGCUGG CUGAUGA X GAA AGUCAGGG | 1248 |
| 3713 | GCAGGACUU CUUUCCCA | 426 | UGGGAAAG CUGAUGA X GAA AGUCCUGC | 1249 |
| 3714 | CAGGACUUC UUUCCCAA | 427 | UUGGGAAA CUGAUGA X GAA AAGUCCUG | 1250 |
| 3716 | GGACUUCUU UCCCAAGG | 428 | CCUGGGA CUGAUGA X GAA AGAAGUCC | 1251 |
| 3717 | GACUUCUUU CCCAAGGA | 429 | UCCUUGGG CUGAUGA X GAA AAGAAGUC | 1252 |
| 3718 | ACUUCUUUC CAAGGAA | 430 | UUCCUUGG CUGAUGA X GAA AAAGAAGU | 1253 |
| 3744 | AAUGGCAUC UUUAAGGU | 431 | CCCUUAAA CUGAUGA X GAA AUGCCAUU | 1254 |
| 3746 | UGGCAUCUU UAAGGGCU | 432 | AGCCCUUA CUGAUGA X GAA AGAUGCCA | 1255 |
| 3747 | GGCAUCUUU AAGGGCUC | 433 | GAGCCCUU CUGAUGA X GAA AAGAUGCC | 1256 |
| 3748 | GCAUCUUUA AGGGCUCC | 434 | GGAGCCCU CUGAUGA X GAA AAAGAUGC | 1257 |
| 3755 | UAAGGGCUC CACACCCUUA | 435 | CAGCUGG CUGAUGA X GAA AGCCCUUA | 1258 |
| 3776 | UGCAGAAUA CCUAAGGG | 436 | CCCUUAGG CUGAUGA X GAA AUUCUGCA | 1259 |
| 3780 | GAAUACCUA AGGGUCGC | 437 | GCGACCCU CUGAUGA X GAA AGGUAUUC | 1260 |
| 3786 | CUAAGGGUC GCGCCACA | 438 | UGUGGCGC CUGAUGA X GAA ACCCUUAG | 1261 |
| 3806 | CAGUGAAUU UAUUGGAG | 439 | CUCCAAUA CUGAUGA X GAA AUUCACUG | 1262 |
| 3807 | AGUGAAUUU AUUGGAGC | 440 | GCUCCAAU CUGAUGA X GAA AAUUCACU | 1263 |
| 3808 | GUGAAUUUA UUGGAGCA | 441 | UGCUCCAA CUGAUGA X GAA AAAUUCAC | 1264 |
| 3810 | GAAUUUAUU GGAGCAUG | 442 | CAUGCUCC CUGAUGA X GAA AUAAAUUC | 1265 |
| 3831 | CGGAGGAUA GUAUGAGC | 443 | GCUCAUAC CUGAUGA X GAA AUCCUCCG | 1266 |
| 3834 | AGGAUAGUA UGAGCCCU | 444 | AGGGCUCA CUGAUGA X GAA ACUAUCCU | 1267 |
| 3843 | UGAGCCCUA AAAAUCCA | 445 | UGGAUUUU CUGAUGA X GAA AGGGCUCA | 1268 |
| 3849 | CUAAAAAUC CAGACUCU | 446 | AGAGUCUG CUGAUGA X GAA AUUUUUAG | 1269 |
| 3856 | UCCAGACUC UUUCGAUA | 447 | UAUCGAAA CUGAUGA X GAA AGUCUGGA | 1270 |
| 3858 | CAGACUCUU UCGAUACC | 448 | GGUAUCGA CUGAUGA X GAA AAGAGUCUG | 1271 |
| 3859 | AGACUCUUU CGAUACCC | 449 | GGGUAUCG CUGAUGA X GAA AAGAGUCU | 1272 |
| 3860 | GACUCUUUC GAUACCCA | 450 | UGGGUAUC CUGAUGA X GAA AAAGAGUC | 1273 |
| 3864 | CUUUCGAUA CCCAGGAC | 451 | GUCCUGGG CUGAUGA X GAA AUCGAAAG | 1274 |
| 3888 | CAGCAGGUC CUCCAUCC | 452 | GGAUGGAG CUGAUGA X GAA ACCUGCUG | 1275 |
| 3891 | CAGGUCCUC CAUCCCAA | 453 | UUGGGAUG CUGAUGA X GAA AGGACCUG | 1276 |
| 3895 | UCCUCCAUC CCAACAGC | 454 | GCUGUUGG CUGAUGA X GAA AUGGAGGA | 1277 |
| 3915 | GCCCGCAUU AGCUCUUA | 455 | UAAGAGCU CUGAUGA X GAA AUGCGGGC | 1278 |
| 3916 | CCCGCAUUA GCUCUUAG | 456 | CUAAGAGC CUGAUGA X GAA AAUGCGGG | 1279 |
| 3920 | CAUUAGCUC UUAGACCC | 457 | GGGUCUAA CUGAUGA X GAA AGCUAAUG | 1280 |
| 3922 | UUAGCUCUU AGACCCAC | 458 | GUGGGUCU CUGAUGA X GAA AGAGCUAA | 1281 |
| 3923 | UAGCUCUUA GACCCACA | 459 | UGUGGGUC CUGAUGA X GAA AAGAGCUA | 1282 |
| 3939 | AGACUGGUU UUGCAACG | 460 | CGUUGCAA CUGAUGA X GAA ACCAGUCU | 1283 |
| 3940 | GACUGGUUU UGCAACGU | 461 | ACGUUGCA CUGAUGA X GAA AACCAGUC | 1284 |
| 3941 | ACUGGUUUU GCAACUU | 462 | AACGUUGC CUGAUGA X GAA AAACCAGU | 1285 |
| 3949 | UGCAACGUU UACACCGA | 463 | UCGGUGUA CUGAUGA X GAA ACGUUGCA | 1286 |
| 3950 | GCAACGUUU ACACCGAC | 464 | GUCGGUGU CUGAUGA X GAA AACGUUGC | 1287 |
| 3951 | CAACGUUUA CACCGACU | 465 | AGUCGGUG CUGAUGA X GAA AAACGUUG | 1288 |
| 3960 | CACCGACUA GCCAGGAA | 466 | UUCCUGGC CUGAUGA X GAA AGUCGGUG | 1289 |
| 3971 | CAGGAAGUA CUUCCACC | 467 | GGUGGAAG CUGAUGA X GAA ACUUCCUG | 1290 |
| 3974 | GAAGUACUU CCACCUCG | 468 | CGAGGUGG CUGAUGA X GAA AGUACUUC | 1291 |
| 3975 | AAGUACUUC CACCUCCG | 469 | CCGAGGUG CUGAUGA X GAA AAGUACUU | 1292 |
| 3981 | UUCCACCUC GGGCACAU | 470 | AUGUGCCC CUGAUGA X GAA AGGUGGAA | 1293 |
| 3990 | GGGCACAUU UGGGAAG | 471 | CUUCCCAA CUGAUGA X GAA AUGUGCCC | 1294 |
| 3991 | GGCACAUUU GGGAAGUU | 472 | ACUUCCGA CUGAUGA X GAA AAUGUGCC | 1295 |
| 3992 | GCACAUUUU GGGAAGUU | 473 | AACUUCCC CUGAUGA X GAA AAAUGUGC | 1296 |
| 4000 | UGGGAAGUU GCAUUCCU | 474 | AGGAAUGC CUGAUGA X GAA ACUUCCCA | 1297 |

TABLE III-continued

Human EGF-R Hammerhead Ribozyme and Target Sequences

| nt. Position | Substrate | Seq. ID NOs. | Ribozyme | Seq. ID NOs. |
|---|---|---|---|---|
| 4005 | AGUUGCAUU CCUUUGUC | 475 | GACAAAGG CUGAUGA X GAA AUGGAACU | 1298 |
| 4006 | GUUGCAUUC CUUUCUCU | 476 | AGACAAAG CUGAUGA X GAA AAUGCAAC | 1299 |
| 4009 | GCAUUCCUU UGUCUUCA | 477 | UGAAGACA CUGAUGA X GAA AGGAAUGC | 1300 |
| 4010 | CAUUCCUUU GUCUUCAA | 478 | UUGAAGAC CUGAUGA X GAA AAGGAAUG | 1301 |
| 4013 | UCCUUUGUC UUCAAACU | 479 | AGUUUGAA CUGAUGA X GAA ACAAAGGA | 1302 |
| 4015 | CUUUGUCUU CAAACUGU | 480 | ACAGUUUG CUGAUGA X GAA AGACAAAG | 1303 |
| 4016 | UUUGUCUUC AAACUGUG | 481 | CACAGUUU CUGAUGA X GAA AAGACAAA | 1304 |
| 4031 | UGAAGCAUU UACAGAAA | 482 | UUUCUGUA CUGAUGA X GAA AUGCUUCA | 1305 |
| 4032 | GAAGCAUUU ACAGAAAC | 483 | GUUUCUGU CUGAUGA X GAA AAUGCUUC | 1306 |
| 4033 | AAGCAUUUA CAGAAACG | 484 | CGUUUCUG CUGAUGA X GAA AAAUGCUU | 1307 |
| 4045 | AAACGCAUC CAGCAAGA | 485 | UCUUGCUG CUGAUGA X GAA AUGCGUUU | 1308 |
| 4056 | GCAAGAAUA UUGUCCCU | 486 | AGGGACAA CUGAUGA X GAA AUUCUUGC | 1309 |
| 4058 | AAGAAUAUU GUCCCUUU | 487 | AAAGGGAC CUGAUGA X GAA AUAUUCUU | 1310 |
| 4061 | AAUAUUGUC CCUUGGAG | 488 | CUCAAAGG CUGAUGA X GAA ACAAUAUU | 1311 |
| 4065 | UUGUCCCUU UGAGCAGA | 489 | UCUGCUCA CUGAUGA X GAA AGGGACAA | 1312 |
| 4066 | UGUCCCUUU GAGCAGAA | 490 | UUCUGCUC CUGAUGA X GAA AAGGGACA | 1313 |
| 4077 | GCAGAAAUU UAUCUUUC | 491 | GAAAGAUA CUGAUGA X GAA AUUUCUGC | 1314 |
| 4078 | CAGAAAUUU AUCUUUCA | 492 | UGAAAGAU CUGAUGA X GAA AAUUUCUG | 1315 |
| 4079 | AGAAAUUUA UCUUUCAA | 493 | UUGAAAGA CUGAUGA X GAA AAAUUUCU | 1316 |
| 4081 | AAAUUUAUC UUUCAAAG | 494 | CUUUGAAA CUGAUGA X GAA AUAAAUUU | 1317 |
| 4083 | AUUUAUCUU UCAAGAG | 495 | CUCUUUGA CUGAUGA X GAA AGAUAAAU | 1318 |
| 4084 | UUUAUCUUU CAAAGAGG | 496 | CCUCUUUG CUGAUGA X GAA AAGAUAAA | 1319 |
| 4085 | UUAUCUUUC AAAGAGGU | 497 | ACCUCUUU CUGAUGA X GAA AAAGAUAA | 1320 |
| 4094 | AAAGAGGUA UAUUUGAA | 498 | UUCAAAUA CUGAUGA X GAA ACCUCUUU | 1321 |
| 4096 | AGAGGUAUA UUUGAAAA | 499 | UUUUCAAA CUGAUGA X GAA AUACCUCU | 1322 |
| 4098 | AGGUAUAUU UGAAAAAA | 500 | UUUUUUCA CUGAUGA X GAA AUAUACCU | 1323 |
| 4099 | GGUAUAUUU GAAAAAAA | 501 | UUUUUUUC CUGAUGA X GAA AAUAUACC | 1324 |
| 4118 | AAAAAAGUA UAUGUGAG | 502 | CUCACAUA CUGAUGA X GAA ACUUUUUU | 1325 |
| 4120 | AAAAGUAUA UGUGAGGA | 503 | UCCUCACA CUGAUGA X GAA AUACUUUU | 1326 |
| 4130 | GUGAGGAUU UUUAUUGA | 504 | UCAAUAAA CUGAUGA X GAA AUCCUCAC | 1327 |
| 4131 | UGAGGAUUU UUAUUGAU | 505 | AUCAAUAA CUGAUGA X GAA AAUCCUCA | 1328 |
| 4132 | GAGGAUUUU UAUUGAUU | 506 | AAUCAAUA CUGAUGA X GAA AAAUCCUC | 1329 |
| 4133 | AGGAUUUUU AUUGAUUG | 507 | CAAUCAAU CUGAUGA X GAA AAAAUCCU | 1330 |
| 4134 | GGAUUUUUA UUGAUUGG | 508 | CCAAUCAA CUGAUGA X GAA AAAAAUCC | 1331 |
| 4136 | AUUUUUAUU GAUUGGGG | 509 | CCCCAAUC CUGAUGA X GAA AUAAAAAU | 1332 |
| 4140 | UUAUUGAUU GGGGAUCU | 510 | AGAUCCCC CUGAUGA X GAA AUCAAUAA | 1333 |
| 4147 | UUGGGGAUC UGGAGUU | 511 | AACUCCAA CUGAUGA X GAA AUCCCCAA | 1334 |
| 4149 | GGGGAUCUU GGACUUUU | 512 | AAAACUCC CUGAUGA X GAA AGAUCCCC | 1355 |
| 4155 | CUUGGAGUU UUUCAUUG | 513 | CAAUGAAA CUGAUGA X GAA ACUCCAAG | 1336 |
| 4156 | UUGGAGUUU UUCAUUGU | 514 | ACAAUGAA CUGAUGA X GAA AACUCCAA | 1337 |
| 4157 | UGGAGUUUU UCAUUGUC | 515 | GACAAUGA CUGAUGA X GAA AAACUCCA | 1338 |
| 4158 | GGAGUUUUU CAUUGUCG | 516 | CGACAAUG CUGAUGA X GAA AAAACUCC | 1339 |
| 4159 | GAGUUUUUC AUUGUCGC | 517 | GCGACAAU CUGAUGA X GAA AAAAACUC | 1340 |
| 4162 | UUUUUCAUU GUCGCUAU | 518 | AUAGCGAC CUGAUGA X GAA AUGAAAAA | 1341 |
| 4165 | UUCAUUGUC GCUAUUGA | 519 | UCAAUAGC CUGAUGA X GAA ACAAUGAA | 1342 |
| 4169 | UUGUCGCUA UUGAUUUU | 520 | AAAAUCAA CUGAUGA X GAA AGCGACAA | 1343 |
| 4171 | GUCGCUAUU GAUUUUUA | 521 | UAAAAAUC CUGAUGA X GAA AUAGCGAC | 1344 |
| 4175 | CUAUUGAUU UUUACUUC | 522 | GAAGUAAA CUGAUGA X GAA AUCAAUAG | 1345 |
| 4176 | UAUUGAUUU UUACUUCA | 523 | UGAAGUAA CUGAUGA X GAA AAUCAAUA | 1346 |
| 4177 | AUUGAUUUU UACUUCAA | 524 | UUGAAGUA CUGAUGA X GAA AAAUCAAU | 1347 |
| 4178 | UUGAUUUUU ACUAUAAU | 525 | AUUGAAGU CUGAUGA X GAA AAAAUCAA | 1348 |
| 4179 | UGAUUUUUA CUUCAAUG | 526 | CAUUGAAG CUGAUGA X GAA AAAAUCA | 1349 |
| 4182 | UUUUUACUU CAAUGGGC | 527 | GCCCAUUG CUGAUGA X GAA AGUAAAAA | 1350 |
| 4183 | UUUUACUUC AAUGGGCU | 528 | AGCCCAUU CUGAUGA X GAA AAGUAAAA | 1351 |
| 4192 | AAUGGGCUC UUCCAACA | 529 | UGUUGGAA CUGAUGA X GAA AGCCCAUU | 1352 |
| 4194 | UGGGCUCUU CCAACAAG | 530 | CUUGUUGG CUGAUGA X GAA AGAGCCCA | 1353 |
| 4195 | GGGCUCUUC CAACAAGG | 531 | CCUUGUUG CUGAUGA X GAA AAGAGCCC | 1354 |
| 4212 | AAGAAGCUU GCUGGUAG | 532 | CUACCAGC CUGAUGA X GAA AGCUUCUU | 1355 |
| 4219 | UUGCUGGUA GCACUUGC | 533 | GCAAGUGC CUGAUGA X GAA ACCAGCAA | 1356 |
| 4225 | GUAGCACUU GCUACCCU | 534 | AGGGUAGC CUGAUGA X GAA AGUGCUAC | 1357 |
| 4229 | CACUUGCUA CCCUGAGU | 535 | ACUCAGGG CUGAUGA X GAA AGCAAGUG | 1358 |
| 4238 | CCCUGAGUU CAUCCAGG | 536 | CCUGGAUG CUGAUGA X GAA ACUCAGGG | 1359 |
| 4239 | CCUGAGUUC AUCCAGGC | 537 | GCCUGGAU CUGAUGA X GAA AACUCAGG | 1360 |
| 4242 | GAGUUCAUC CAGGCCCA | 538 | UGGGCCUG CUGAUGA X GAA AGAACUC | 1361 |
| 4280 | CCACAAGUC UUCCAGAG | 539 | CUCUGGAA CUGAUGA X GAA ACUUGUGG | 1362 |
| 4282 | ACAAGUCUU CCAGAGGA | 540 | UCCUCUGG CUGAUGA X GAA AGACUUGU | 1363 |
| 4283 | CAAGUCUUC CAGAGGAU | 541 | AUCCUCUG CUGAUGA X GAA AAGACUUG | 1364 |
| 4295 | AGGAUGCUU GAUUCCAG | 542 | CUGGAAUC CUGAUGA X GAA AGCAUCCU | 1365 |
| 4299 | UGCUUGAUU CCAGUGGU | 543 | ACCACUGG CUGAUGA X GAA AUCAAGCA | 1366 |
| 4300 | GCUUGAUUC CAGUGGUU | 544 | AACCACUG CUGAUGA X GAA AAUCAAGC | 1367 |
| 4308 | CCAGUGGUU CUGCUUCA | 545 | UGAAGCAG CUGAUGA X GAA ACCACUGG | 1368 |
| 4309 | CAGUGGUUC UGCUUCAA | 546 | UUGAAGCA CUGAUGA X GAA AACCACUG | 1369 |
| 4314 | GUUCUGCUU CAAGGCUU | 547 | AAGCCUUG CUGAUGA X GAA AGCAGAAC | 1370 |
| 4315 | UUCUGCUUC AAGGCUUC | 548 | GAAGCCUU CUGAUGA X GAA AAGCAGAA | 1371 |

TABLE III-continued

Human EGF-R Hammerhead Ribozyme and Target Sequences

| nt. Position | Substrate | Seq. ID NOs. | Ribozyme | Seq. ID NOs. |
|---|---|---|---|---|
| 4322 | UCAAGGCUU CCACUGCA | 549 | UGCAGUGG CUGAUGA X GAA AGCCUUGA | 1372 |
| 4323 | CAAGGCUUC CACUGCAA | 550 | UUGCAGUG CUGAUGA X GAA AAGCCUUG | 1373 |
| 4338 | AAAACACUA AAGAUCCA | 551 | UGGAUCUU CUGAUGA X GAA AGUGUUUU | 1374 |
| 4344 | CUAAAGAUC CAAGAAGG | 552 | CCUUCUUG CUGAUGA X GAA AUCUUUAG | 1375 |
| 4356 | GAAGGCUUC CAUGGCCC | 553 | GGGCCAUG CUGAUGA X GAA AGGCCUUC | 1376 |
| 4357 | AAGGCCUUC AUGGCCCC | 554 | GGGGCCAU CUGAUGA X GAA AAGGCCUU | 1377 |
| 4378 | GGCCGGAUC GGUACUGU | 555 | ACAGUACC CUGAUGA X GAA AUCCGGCC | 1378 |
| 4382 | GGAUCGGUA CUGUAUCA | 556 | UGAUACAG CUGAUGA X GAA ACCGAUCC | 1379 |
| 4387 | GGUACUGUA UCAAGUCA | 557 | UGACUUGA CUGAUGA X GAA ACAGUACC | 1380 |
| 4389 | UACUGUAUC AAGUCAUG | 558 | CAUGACUU CUGAUGA X GAA AUACAGUA | 1381 |
| 4394 | UAUCAAGUC AUGGCAGG | 559 | CCUGCCAU CUGAUGA X GAA ACUUGAUA | 1382 |
| 4404 | UGGCAGGUA CAGUAGGA | 560 | UCCUACUG CUGAUGA X GAA ACGUGCCA | 1383 |
| 4409 | GGUACAGUA GGAUAAGC | 561 | GCUUAUCC CUGAUGA X GAA ACUGUACC | 1384 |
| 4414 | AGUAGGAUA AGCCACUC | 562 | GAGUGGCU CUGAUGA X GAA AUCCUACU | 1385 |
| 4422 | AAGCCACUC UGUCCCUU | 563 | AAGGGACA CUGAUGA X GAA AGUGGCUU | 1386 |
| 4426 | CACUCUGUC CGUCCUG | 564 | CAGGAAGG CUGAUGA X GAA ACAGAGUG | 1387 |
| 4430 | CUGUCCCUU CCUGGGCA | 565 | UGCCCAGG CUGAUGA X GAA AGGGACAG | 1388 |
| 4431 | UGUCCCUUC CUGGGCAA | 566 | UUGCCCAG CUGAUGA X GAA AAGGGACA | 1389 |
| 4462 | GGAUGAAUU CUUCCUUA | 567 | UAAGGAAG CUGAUGA X GAA AUUCAUCC | 1390 |
| 4463 | GAUGAAUUC UUCCUUAG | 568 | CUAAGGAA CUGAUGA X GAA AAUUCAUC | 1391 |
| 4465 | UGAAUUCUU CCUUAGAC | 569 | GUCUAAGG CUGAUGA X GAA AGAAUUCA | 1392 |
| 4466 | GAAUUCUUC CUUAGACU | 570 | AGUCUAAG CUGAUGA X GAA AAGAAUUC | 1393 |
| 4469 | UUCUUCCUU AGACUUAC | 571 | GUAAGUCU CUGAUGA X GAA AAGGAAGA | 1394 |
| 4470 | UCUUCCUUA GACUUACU | 572 | AGUAAGUC CUGAUGA X GAA AAGGAAGA | 1395 |
| 4475 | CUUAGACUU ACUUUUGU | 573 | ACAAAAGU CUGAUGA X GAA AGUCUAAG | 1396 |
| 4476 | UUAGACUUA CUUUUGUA | 574 | UACAAAAG CUGAUGA X GAA AAGUCUAA | 1397 |
| 4479 | GACUUACUU UGUAAAGA | 575 | UUUUACAA CUGAUGA X GAA AGUAAGUC | 1398 |
| 4480 | ACUUACUUU GUAAAAAU | 576 | UUUUUACA CUGAUGA X GAA AAGUAAGU | 1399 |
| 4481 | CUUACUUUU GUAAAAAU | 577 | AUUUUAUU CUGAUGA X GAA AAAGUAAG | 1400 |
| 4484 | ACUUUGUA AAAAUGUC | 578 | GACAUUUU CUGAUGA X GAA ACAAAAGU | 1401 |
| 4492 | AAAAAUGUC CCCACGGU | 579 | ACCGUGGG CUGAUGA X GAA ACAUUUUU | 1402 |
| 4501 | CCCACGGUA CUUACUCC | 580 | GGAGUAAG CUGAUGA X GAA ACCGUGGG | 1403 |
| 4504 | ACGGUACUU ACUCCCCA | 581 | UGGGGACU CUGAUGA X GAA AGUACCGU | 1404 |
| 4505 | CGGUACUUA CUCCCCAC | 582 | GUGGGGAG CUGAUGA X GAA AAGUACCG | 1405 |
| 4508 | UACUUACUC CCACAGUA | 583 | UCAGUGGG CUGAUGA X GAA AGUAAGUA | 1406 |
| 4529 | CCAGUGGUU UCCAGUCA | 584 | UGACUGGA CUGAUGA X GAA ACCACUGG | 1407 |
| 4530 | CAGUGGUUU CCACUCAU | 585 | AUGACUGG CUGAUGA X GAA AACCACUG | 1408 |
| 4531 | AGUGGUUUC CAGUCAUG | 586 | CAUGACUG CUGAUGA X GAA AAACCACU | 1409 |
| 4536 | UUUCCAGUC AUGAGCGU | 587 | ACGCUCAU CUGAUGA X GAA ACUGGAAA | 1410 |
| 4545 | AUGAGCGUU AGACUGAC | 588 | GUCAGUCU CUGAUGA X GAA ACGCUCAU | 1411 |
| 4546 | UGAGCGUUA GACUGACU | 589 | AGUCAGUC CUGAUGA X GAA AACGCUCA | 1412 |
| 4555 | GACUGACUU GUUUGUCU | 590 | AGACAAAC CUGAUGA X GAA AGUCAGUC | 1413 |
| 4558 | UGACUUGUU UGUCUUCC | 591 | GGAAGACA CUGAUGA X GAA ACAAGUCA | 1414 |
| 4559 | GACUUGUUU GUCUUCCA | 592 | UGGAAGAC CUGAUGA X GAA AACAAGUC | 1415 |
| 4562 | UUGUUUGUC UUCCAUUC | 593 | GAAUGGAA CUGAUGA X GAA ACAAACAA | 1416 |
| 4564 | GUUUGUCUU CCAUUCCA | 594 | UGGAAUGG CUGAUGA X GAA AGACAAAC | 1417 |
| 4565 | UUUGUCUUC CAUUCCAU | 595 | AUGGAAUG CUGAUGA X GAA AAGACAAA | 1418 |
| 4569 | UCUUCCAUU CCAUUGUU | 596 | AACAAUGG CUGAUGA X GAA AAUGGAAG | 1419 |
| 4570 | CUUCCAUUC CAUUGUUU | 597 | AAACAAUG CUGAUGA X GAA AAUGGAAG | 1420 |
| 4574 | CAUUCCAUU GUUUGAA | 598 | UUCAAAAC CUGAUGA X GAA AUGGAAUG | 1421 |
| 4577 | UCCAUUGUU UUGAAACU | 599 | AGUUUCAA CUGAUGA X GAA ACAAUGGA | 1422 |
| 4578 | CCAUUGUUU UGAAACUC | 600 | GAGUUUCA CUGAUGA X GAA AACAAUGG | 1423 |
| 4579 | CAUUGUUUU GAAACUCA | 601 | UGAGUUUC CUGAUGA X GAA AAACAAUG | 1424 |
| 4586 | UUGAAACUC AGUAUGCC | 602 | GGCAUACU CUGAUGA X GAA AGUUUCAA | 1425 |
| 4590 | AACUCAGUA UGCCGCCC | 603 | GGGCGGCA CUGAUGA X GAA ACUGAGUU | 1426 |
| 4603 | GCCCCUGUC UUGCUGGGC | 604 | GACAGCAA CUGAUGA X GAA ACAGGGGC | 1427 |
| 4605 | CCCUGUCUU GCUGUCAU | 605 | AUGACAGC CUGAUGA X GAA AGACAGGG | 1428 |
| 4611 | CUUGCUGUC AUGAAAUC | 606 | GAUUUCAU CUGAUGA X GAA ACAGCAAG | 1429 |
| 4619 | CAUGAAAUC AGCAAGAG | 607 | CUCUUGCU CUGAUGA X GAA AUUUCAUG | 1430 |
| 4640 | UGACACAUC AAAUAUA | 608 | UAUUAUUU CUGAUGA X GAA AUGUGUCA | 1431 |
| 4645 | CAUCAAAUA AUAACUCG | 609 | CGAGUUAU CUGAUGA X GAA AUUUGAUG | 1432 |
| 4648 | CAAAUAAUA ACUCGGAU | 610 | AUCCGAGU CUGAUGA X GAA AUUAUUUG | 1433 |
| 4652 | UAAUAACUC GGAUUCCA | 611 | UGGAAUCC CUGAUGA X GAA AGUUAUUA | 1434 |
| 4657 | ACUCGGAUU CCAGCCCA | 612 | UGGGCUGG CUGAUGA X GAA AUCCGAGU | 1435 |
| 4658 | CUCGGAUUC CAGCCCAC | 613 | GUGGGCUG CUGAUGA X GAA AAUCCGAG | 1436 |
| 4669 | GCCCACAUU GGAUUCAU | 614 | AUGAAUCC CUGAUGA X GAA AUGUGGGC | 1437 |
| 4674 | CAUUGGAUU CAUCACCA | 615 | UGCUGAUG CUGAUGA X GAA AUCCAAUG | 1438 |
| 4675 | AUUGGAUUC AUCAGCAU | 616 | AUGCUGAU CUGAUGA X GAA AAUCCAAU | 1439 |
| 4678 | GGAUUCAUC AGCAUUUG | 617 | CAAAUGCU CUGAUGA X GAA AUGAAUCC | 1440 |
| 4684 | AUCAGCAUU GGACCAA | 618 | UUGGUCCA CUGAUGA X GAA AUGCUGAU | 1441 |
| 4685 | UCAGCAUUU GGACCAAU | 619 | AUUGGUCC CUGAUGA X GAA AAUGCUGA | 1442 |
| 4694 | GGACCAAUA GCCCACAG | 620 | CUGUGGGC CUGAUGA X GAA AUUGGUCC | 1443 |
| 4718 | UGUGGAAUA CCUAAGGA | 621 | UCCUUAGG CUGAUGA X GAA AUUCCACA | 1444 |
| 4722 | GAAUACCUA AGGAUAAC | 622 | GUUAUCCU CUGAUGA X GAA AGGUAUUC | 1445 |

TABLE III-continued

Human EGF-R Hammerhead Ribozyme and Target Sequences

| nt. Position | Substrate | Seq. ID NOs. | Ribozyme | Seq. ID NOs. |
|---|---|---|---|---|
| 4728 | CUAAGGAUA ACACCGCU | 623 | AGCGGUGU CUGAUGA X GAA AUCCUUAG | 1446 |
| 4737 | ACACCGCUU UUGUUCUC | 624 | GAGAACAA CUGAUGA X GAA AGCGGUGU | 1447 |
| 4738 | CACCGCUUU UGUUCUCG | 625 | CGAGAACA CUGAUGA X GAA AAGCGGUG | 1448 |
| 4739 | ACCGCUUUU GUUCUCGC | 626 | GCGAGAAC CUGAUGA X GAA AAAGCGGU | 1449 |
| 4742 | GCUUUUGUU CUCGCAAA | 627 | UUUGCGAG CUGAUGA X GAA ACAAAAGC | 1450 |
| 4743 | CUUUUGUUC UCGCAAAA | 628 | UUUUGCGA CUGAUGA X GAA AACAAAAG | 1451 |
| 4745 | UUUGUUCUC GCAAAAAC | 629 | GUUUUUGC CUGAUGA X GAA AGAACAAA | 1452 |
| 4756 | AAAAACGUA UCUCCUAA | 630 | UUAGGAGA CUGAUGA X GAA ACGUUUUU | 1453 |
| 4758 | AAACGUAUC UCCUAAUU | 631 | AAUUAGGA CUGAUGA X GAA AUACGUUU | 1454 |
| 4760 | ACGUAUCUC CUAAUUUG | 632 | CAAAUUAG CUGAUGA X GAA AGAUACGU | 1455 |
| 4763 | UAUCUCCUA AUUUGAGG | 633 | CCUCAAAU CUGAUGA X GAA AGGAGAUA | 1456 |
| 4766 | CUCCUAAUU UGAGGCUC | 634 | GAGCCUCA CUGAUGA X GAA AUUAGGAG | 1457 |
| 4767 | UCCUAAUUU GAGGCUCA | 635 | UGAGCCUC CUGAUGA X GAA AAUUAGGA | 1458 |
| 4774 | UUGAGGCUC AGAUGAAA | 636 | UUUCAUCU CUGAUGA X GAA AGCCUCAA | 1459 |
| 4788 | AAAUGCAUC AGGUCCUU | 637 | AAGGACCU CUGAUGA X GAA AUGCAUUU | 1460 |
| 4793 | CAUCAGGUC CUUUGGGG | 638 | CCCCAAAG CUGAUGA X GAA ACCUGAUG | 1461 |
| 4796 | CAGGUCCUU UGGGGCAU | 639 | AUGCCCCA CUGAUGA X GAA AGGACCUG | 1462 |
| 4797 | AGGUCCUUU GGGGCAUA | 640 | UAUGCCCC CUGAUGA X GAA AAGGACCU | 1463 |
| 4805 | UGGGGCAUA GAUCAGAA | 641 | UUCUGAUC CUGAUGA X GAA AUGCCCCA | 1464 |
| 4809 | GCAUAGAUC AGAAGACU | 642 | AGUCUUCU CUGAUGA X GAA AUCUAUGC | 1465 |
| 4818 | AGAAGACUA CAAAAAUG | 643 | CAUUUUUG CUGAUGA X GAA AGUCUUCU | 1466 |
| 4835 | AAGCUGCUC UGAAAUCU | 644 | AGAUUUCA CUGAUGA X GAA AGCAGCUU | 1467 |
| 4842 | UCUGAAAUC UCCUUUAG | 645 | CUAAAGGA CUGAUGA X GAA AUUUCAGA | 1468 |
| 4844 | UGAAAUCUC CUUUAGCC | 646 | GGCUAAAG CUGAUGA X GAA AGAUUUCA | 1469 |
| 4847 | AAUCUCCUU UAGCCAUC | 647 | GAUGGCUA CUGAUGA X GAA AGGAGAUU | 1470 |
| 4848 | AUCUCCUUU AGCCAUCA | 648 | UGAUGGCU CUGAUGA X GAA AAGGAGAU | 1471 |
| 4849 | UCUCCUUUA GCCAUCAC | 649 | GUGAUGGC CUGAUGA X GAA AAAGGAGA | 1472 |
| 4855 | UUAGCCAUC ACCCCAAC | 650 | CUUGGGGU CUGAUGA X GAA AUGGCUAA | 1473 |
| 4874 | CCCAAAAUU AGUUUGUG | 651 | CACAAACU CUGAUGA X GAA AUUUUGGG | 1474 |
| 4875 | CCAAAAUUA GUUUGUGU | 652 | ACACAAAC CUGAUGA X GAA AAUUUUGG | 1475 |
| 4878 | AAAUUAGUU UGUGUUAC | 653 | GUAACACA CUGAUGA X GAA ACUAAUUU | 1476 |
| 4879 | AAUUAGUUU GUGUUACU | 654 | AGUAACAC CUGAUGA X GAA AACUAAUU | 1477 |
| 4884 | GUUUGUGUU ACUAUGG | 655 | CCAUAAGU CUGAUGA X GAA ACACAAAC | 1478 |
| 4885 | UUUGUGUUA CUUAUGGA | 656 | UCCAUAAG CUGAUGA X GAA AACACAAA | 1479 |
| 4888 | GUGUUACUU AUGGAAGA | 657 | UCUUCCAU CUGAUGA X GAA AGUAACAC | 1480 |
| 4889 | UGUUACUUA UGGAAGAU | 658 | AUCUUCCA CUGAUGA X GAA AAGUAACA | 1481 |
| 4898 | UGGAAGAUA GUUUCUC | 659 | GAGAAAAC CUGAUGA X GAA AUCUUCCA | 1482 |
| 4901 | AAGAUAGUU UCUCCUU | 660 | AAGGAGAA CUGAUGA X GAA ACUAUCUU | 1483 |
| 4902 | AGAUAGUUU CUCCUUUA | 661 | AAAGGAGA CUGAUGA X GAA AACUAUCU | 1484 |
| 4903 | GAUAGUUUC UCCUUUUU | 662 | AAAAGGAG CUGAUGA X GAA AAACUAUC | 1485 |
| 4904 | AUAGUUUCU CCUUUUAC | 663 | UAAAAGGA CUGAUGA X GAA AAAACUAU | 1486 |
| 4906 | AGUUUCUCC UUUUACU | 664 | AGUAAAAG CUGAUGA X GAA AGAAACU | 1487 |
| 4909 | UUUCUCCUU UUACUUCA | 665 | UGAAGUAA CUGAUGA X GAA AGGAGAAA | 1488 |
| 4910 | UUCUCCUUU UACUUCAC | 666 | GUGAAGUA CUGAUGA X GAA AAGGAGAA | 1489 |
| 4911 | UCUCCUUUU ACUUCACU | 667 | AGUGAAGU CUGAUGA X GAA AAAGGAGA | 1490 |
| 4912 | CUCCUUUUA CUUCACUU | 668 | AAGUGAAG CUGAUGA X GAA AAAAGGAG | 1491 |
| 4915 | CUUUUACUU CACUUCAA | 669 | UUGAAGUG CUGAUGA X GAA AGUAAAAG | 1492 |
| 4916 | UUUUACUUC ACUUCAAA | 670 | UUUGAAGU CUGAUGA X GAA AGUAAAA | 1493 |
| 4920 | ACUUCACUU CAAAAGCU | 671 | AGCUUUUG CUGAUGA X GAA AGUGAAGU | 1494 |
| 4921 | CUUCACUUC AAAAGCUU | 672 | AAGCUUUU CUGAUGA X GAA AAGUGAAG | 1495 |
| 4929 | CAAAAGCUU UUUACUCA | 673 | UGAGUAAA CUGAUGA X GAA AGCUUUUG | 1496 |
| 4930 | AAAAGCUUU UUACUCAA | 674 | UUGAGUAA CUGAUGA X GAA AAGCUUUU | 1497 |
| 4931 | AAAGCUUUU UACUCAAA | 675 | UUUGAGUA CUGAUGA X GAA AAAGCUUU | 1498 |
| 4932 | AAGCUUUUU ACUCAAAG | 676 | CUUUGAGU CUGAUGA X GAA AAAAGCUU | 1499 |
| 4933 | AGCUUUUUA CUCAAAGA | 677 | UCUUUGAG CUGAUGA X GAA AAAAAGCU | 1500 |
| 4936 | UUUUUACUC AAAGAGUA | 678 | UACUCUUU CUGAUGA X GAA AGUAAAAA | 1501 |
| 4944 | CAAAGAGUA UAUGUUCC | 679 | GGAACAUA CUGAUGA X GAA ACUCUUUG | 1502 |
| 4946 | AAGAGUAUA UGUUCCCU | 680 | AGGGAACA CUGAUGA X GAA AUACUCUU | 1503 |
| 4950 | GUAUAUGUU CCCUCCAG | 681 | CUGGAGGG CUGAUGA X GAA ACAUAUAC | 1504 |
| 4951 | UAUAUGUUC CCUCCAGU | 682 | ACUGGAGG CUGAUGA X GAA AACAUAUA | 1505 |
| 4955 | UGUUCCCUC CAGGUCAG | 683 | CUGACCUG CUGAUGA X GAA AGGGAACA | 1506 |
| 4961 | CUCCAGGUC AGCUGCCC | 684 | GGGCAGCU CUGAUGA X GAA ACCUGGAG | 1507 |
| 4981 | AACCCCCUC CUUACGCU | 685 | AGCGUAAG CUGAUGA X GAA AGGGGGUU | 1508 |
| 4984 | CCCCCUCCU UACGCUUUG | 686 | CAAAGCGU CUGAUGA X GAA AGGAGGGG | 1509 |
| 4985 | CCCUCCUUA CGCUUUGU | 687 | ACAAAGCG CUGAUGA X GAA AAGGAGGG | 1510 |
| 4990 | CUUACGCUU UGUCACAC | 688 | GUGUGACA CUGAUGA X GAA AGCGUAAG | 1511 |
| 4991 | UUACGCUUU GUCACACA | 689 | UGUGUGAC CUGAUGA X GAA AAGCGUAA | 1512 |
| 4994 | CGCUUUGUC ACACAAAA | 690 | UUUUGUGU CUGAUGA X GAA ACAAAGCG | 1513 |
| 5008 | AAAAGUGUC UCUGCCUU | 691 | AAGGCAGA CUGAUGA X GAA AGACCUUU | 1514 |
| 5010 | AAGUGUCUC UGCCUUGA | 692 | UCAAGGCA CUGAUGA X GAA AGACACUU | 1515 |
| 5016 | CUCUGCCUU GAGUCAUC | 693 | GAUGACUC CUGAUGA X GAA AGGCAGAG | 1516 |
| 5021 | CCUUGAGUC AUCUAUUC | 694 | GAAUAGAU CUGAUGA X GAA ACUCAAGG | 1517 |
| 5024 | UGAGUCAUC UAUUCAAG | 695 | CUUGAAUA CUGAUGA X GAA AUGACUCA | 1518 |
| 5026 | AGUCAUCUA UUCAAGCA | 696 | UGCUUGAA CUGAUGA X GAA AGAUGACU | 1519 |

TABLE III-continued

Human EGF-R Hammerhead Ribozyme and Target Sequences

| nt. Position | Substrate | Seq. ID NOs. | Ribozyme | Seq. ID NOs. |
|---|---|---|---|---|
| 5028 | UCAUCUAUU CAAGCACU | 697 | AGUGCUUG CUGAUGA X GAA AUAGAUGA | 1520 |
| 5029 | CAUCUAUUC AAGOACUU | 698 | AAGUGCUU CUGAUGA X GAA AUAGAUGA | 1521 |
| 5037 | CAAGCACUU ACAGCUCU | 699 | AGAGCUGU CUGAUGA X GAA AGUGCUUG | 1522 |
| 5038 | AAGCACUUA CAGCUCUG | 700 | CAGAGCUG CUGAUGA X GAA AAGUGCUU | 1523 |
| 5G44 | UUACAGCUC UGGCCACA | 701 | UGUGGCCA CUGAUGA X GAA AGCUGUAA | 1524 |
| 5062 | CAGGGCAUU UUACAGGU | 702 | ACCUGUAA CUGAUGA X GAA AUGCCCUG | 1525 |
| 5063 | AGGGCAUUU UACAGGUG | 703 | CACCUGUA CUGAUGA X GAA AAUGCCCU | 1526 |
| 5064 | GGGCAUUUU ACAGGUGC | 704 | GCACCUGU CUGAUGA X GAA AAAUGCCC | 1527 |
| 5065 | GGCAUUUUA CAGGUGCG | 705 | CGCACCUG CUGAUGA X GAA AAAAUGCC | 1528 |
| 5083 | AUGACAGUA GCAUUAUG | 706 | CAUAAUGC CUGAUGA X GAA ACUGUCAU | 1529 |
| 5088 | AGUAGCAUU AUGAGUAG | 707 | CUACUCAU CUGAUGA X GAA AUGCUACU | 1530 |
| 5089 | GUAGCAUUA UGAGUAGU | 708 | ACUACUCA CUGAUGA X GAA AAUGCUAC | 1531 |
| 5095 | UUAUGAGUA GUGUGAAU | 709 | AUUCACAC CUGAUGA X GAA ACUCAUAA | 1532 |
| 5104 | GUGUGAAUU CAGGUAGA | 710 | ACUACCUG CUGAUGA X GAA AUUCACAC | 1533 |
| 5105 | UGUGAAUUC AGGUAGUA | 711 | UACUACCU CUGAUGA X GAA AAUUCACA | 1534 |
| 5110 | AUUCAGGUA GUAAAUAU | 712 | AUAUUUAC CUGAUGA X GAA ACCUGAAU | 1535 |
| 5113 | CAGGUAGUA AAUAUGAA | 713 | UUCAUAUU CUGAUGA X GAA ACUACCUG | 1536 |
| 5117 | UAGUAAAUA UGAAACUA | 714 | UAGUUACA CUGAUGA X GAA AUAUUUAC | 1537 |
| 5125 | AUGAAACUA GGGUUUGA | 715 | UCAAACCC CUGAUGA X GAA AGUUUCAU | 1538 |
| 5130 | ACUAGGGUU UGAAAUUG | 716 | CAAUUUCA CUGAUGA X GAA ACCCUAGU | 1539 |
| 5131 | CUAGGGUUU GAAAUUGA | 717 | UCAAUUUC CUGAUGA X GAA AACCCUAG | 1540 |
| 5137 | UUUGAAAUU GAUAAUGC | 718 | GCAUUAUC CUGAUGA X GAA AUUUCAAA | 1541 |
| 5141 | AAAUGGAUA AUGCUUUC | 719 | GAAAGCAU CUGAUGA X GAA AUCAAUUU | 1542 |
| 5147 | AUAAUGCUU UCACAACA | 720 | UGUUGUGA CUGAUGA X GAA AGCAUUAU | 1543 |
| 7775148 | UAAUGCUUU CACAACAU | 721 | AUGUUGUG CUGAUGA X GAA AAGCAUUA | 1544 |
| 5149 | AAUGCUUUC ACAACAUU | 722 | AAUGUUGU CUGAUGA X GAA AAAGCAUU | 1545 |
| 5157 | CACAACAUU UGCAGAUG | 723 | CAUCUGCA CUGAUGA X GAA AAUGUUGU | 1546 |
| 5158 | ACAACAUUU GCAGAUGU | 724 | ACAUCUGC CUGAUGA X GAA AAUGUUGU | 1547 |
| 5167 | GCAGAUGUU UUAGAAGG | 725 | CCUUCUAA CUGAUGA X GAA ACAUCUGC | 1548 |
| 5168 | CAGAUGUUU UAGAAGGA | 726 | UCCUUCUA CUGAUGA X GAA AACAUCUG | 1549 |
| 5169 | AGAUGUUUU AGAAGGAA | 727 | UUCCUUCU CUGAUGA X GAA AAACAUCU | 1550 |
| 5170 | GAUGUUUUA GAAGGAAA | 728 | UUUCCUUC CUGAUGA X GAA AAAACAUC | 1551 |
| 5184 | AAAAAAGUU CCUUCCUA | 729 | UAGGAAGG CUGAUGA X GAA ACUUUUUU | 1552 |
| 51B5 | AAAAAGUUC CUUCCUAA | 730 | UUAGGAAG CUGAUGA X GAA AACUUUUU | 1553 |
| 5188 | AAGUUCCUU CCUAAAAU | 731 | AUUUUAGG CUGAUGA X GAA AAGGAACU | 1554 |
| 5189 | AGUUCCUUC CUAAAAUA | 732 | UAUUUUAG CUGAUGA X GAA AAGGAACU | 1555 |
| 5192 | UCCUUCCUA AAAUAAUU | 733 | AAUUAUUU CUGAUGA X GAA AGGAAGGA | 1556 |
| 5197 | CCUAAAAUA AUUUCUCU | 734 | AGAGAAAU CUGAUGA X GAA AUUUUAGG | 1557 |
| 5200 | AAAAUAAUU UCUCUACA | 735 | UGUAGAGA CUGAUGA X GAA AAUUAUUU | 1558 |
| 5201 | AAAUAAUUU CUCUACAA | 736 | UUGUAGAG CUGAUGA X GAA AAUUAUUU | 1559 |
| 5202 | AAUAAUUUC UCUACAAU | 737 | AUUGUAGA CUGAUGA X GAA AAAUUAUU | 1560 |
| 5204 | UAAUUUCUC UACAAUUG | 738 | CAAUUGUA CUGAUGA X GAA AGAAAUUA | 1561 |
| 5206 | AUUUCUCUA CAAUUGGA | 739 | UCCAAUUG CUGAUGA X GAA AGAGAAAU | 1562 |
| 5211 | UCUACAAUU GGAAGAUU | 740 | AAUCUUCC CUGAUGA X GAA AUUGUAGA | 1563 |
| 5219 | UGGAAGAUU GGAAGAUU | 741 | AAUCUUCC CUGAUGA X GAA AUCUUCCA | 1564 |
| 5227 | UGGAAGAUU CAGCUAGU | 742 | ACUAGCUG CUGAUGA X GAA AUCUUCCA | 1565 |
| 5228 | GGAAGAUUC AGCUAGUU | 743 | AACUAGCU CUGAUGA X GAA AAUCUUCC | 1566 |
| 5233 | AUUCAGCUA GUUAGGAG | 744 | CUCCUAAC CUGAUGA X GAA AGCUGAAU | 1567 |
| 5236 | CAGCUAGUU AGGAGCCC | 745 | GGGCUCCU CUGAUGA X GAA ACUAGCUG | 1568 |
| 5237 | AGCUAGUUA GGAGCCCA | 746 | UGGGCUCC CUGAUGA X GAA AACUAGCU | 1569 |
| 5247 | GAGCCCAUU UUUCCUA | 747 | UAGGAAAA CUGAUGA X GAA AUGGGCUC | 1570 |
| 5248 | AGCCCAUUU UUCCUAA | 748 | UUAGGAAA CUGAUGA X GAA AAUGGGCU | 1571 |
| 5249 | GCCCAUUUU UUCCUAAU | 749 | AUUAGGAA CUGAUGA X GAA AAAUGGGC | 1572 |
| 5250 | CCCAUUUUU UCCUAAUC | 750 | GAUUAGGA CUGAUGA X GAA AAAAUGGG | 1573 |
| 5251 | CCAUUUUUU CCUAAUCU | 751 | AGAUUAGG CUGAUGA X GAA AAAAAUGG | 1574 |
| 5252 | CAUUUUUUC CUAAUCUG | 752 | CAGAUUAG CUGAUGA X GAA AAAAAUG | 1575 |
| 5255 | UUUUUCCUA AUCUGUGU | 753 | ACACAGAU CUGAUGA X GAA AGGAAAAA | 1576 |
| 5258 | UUCCUAAUC UGUGUGUG | 754 | CACACACA CUGAUGA X GAA AUUAGGAA | 1577 |
| 5273 | UGCCCUGUA ACCUGACU | 755 | AGUCAGGU CUGAUGA X GAA ACAGGGCA | 1578 |
| 5285 | UGACUGGUU AACAGCAGU | 756 | CUGCUGUU CUGAUGA X GAA ACCAGUCA | 1579 |
| 5286 | GACUGGUUA ACAGCAGU | 757 | ACUGCUGU CUGAUGA X GAA AACCAGUC | 1580 |
| 5295 | ACAGCAGUC UUUGUAA | 758 | UUACAAAG CUGAUGA X GAA ACUGCUGU | 1581 |
| 5298 | GCAGUCCUU GUAAACA | 759 | UGUUUACA CUGAUGA X GAA AGGACGC | 1582 |
| 5299 | CAGUCCUUU GUAAACAG | 760 | CUGUUUAC CUGAUGA X GAA AAGGACUG | 1583 |
| 5302 | UCCUUGUGA AACAGUGU | 761 | ACACUGUU CUGAUGA X GAA ACAAAGGA | 1584 |
| 5311 | AACAGUGUU UAAACUC | 762 | GAGUUUAA CUGAUGA X GAA ACACUGUU | 1585 |
| 5312 | ACAGUCUUU UAAACUCU | 763 | AGAGUUUA CUGAUGA X GAA AACACUGU | 1586 |
| 5313 | CAGUGUUUU AAACUCUC | 764 | GAGAGUUU CUGAUGA X GAA AAACACUG | 1587 |
| 5314 | AGUGGUUUA AACUCUCC | 765 | GGAGAGGU CUGAUGA X GAA AAACACU | 1588 |
| 5319 | UUUAAACUC UCCUAGUC | 766 | GACUAGGA CUGAUGA X GAA AGUUUAAA | 1589 |
| 5321 | UAAACUCUC CUAGUCAA | 767 | UUGACUAG CUGAUGA X GAA AGAGUUUA | 1590 |
| 5324 | ACUCUCCUA GUCAAUAU | 768 | AUAUUGAC CUGAUGA X GAA AGGAGAGU | 1591 |
| 5327 | CUCCUAGUC AAUAUCCA | 769 | UGGAUAUU CUGAUGA X GAA ACUAGGAG | 1592 |
| 5331 | UAGUCAAUA UCCACCCC | 770 | GGGGUGGA CUGAUGA X GAA AUUGACUA | 1593 |

TABLE III-continued

Human EGF-R Hammerhead Ribozyme and Target Sequences

| nt. Position | Substrate | Seq. ID NOs. | Ribozyme | Seq. ID NOs. |
|---|---|---|---|---|
| 5333 | GUCAAUAUC CACCCCAU | 771 | AUGGGGUG CUGAUGA X GAA AUAUUGAC | 1594 |
| 5342 | CACCCCAUC CAAUUUAU | 772 | AUAAAUUG CUGAUGA X GAA AUGGGGUG | 1595 |
| 5347 | CAUCCAAUU UAUCAAGG | 773 | CCUUGAUA CUGAUGA X GAA AUUGGAUC | 1596 |
| 5348 | AUCCAAUUU AUCAAGGA | 774 | UCCUUGAU CUGAUGA X GAA AAUUGGAU | 1597 |
| 5349 | UCCAAUUUA UCAAGGAA | 775 | UUCCUUGA CUGAUGA X GAA AAAUUGGA | 1598 |
| 5351 | CAAUUUAUC AAGGAAGA | 776 | UCUUCCUU CUGAUGA X GAA AUAAAUUG | 1599 |
| 5366 | GAAAUGGUA CAGAAAAU | 777 | AUUUUCUG CUGAUGA X GAA ACCAUUUC | 1600 |
| 5367 | AAAUGGUUC AGAAAAUA | 778 | UAUUUUCU CUGAUGA X GAA AACCAUUU | 1601 |
| 5375 | CAGAAAAUA UUUUCAGC | 779 | GCUGAAAA CUGAUGA X GAA AUUUUCUG | 1602 |
| 5377 | GAAAAUAUU UUCAGCCU | 780 | AGGCUGAA CUGAUGA X GAA AAUAUUUU | 1603 |
| 5378 | AAAAUAUUU UCAGCCUA | 781 | UAGGCUGA CUGAUGA X GAA AAUAUUUU | 1604 |
| 5379 | AAAUAUUUU CAGCCUAC | 782 | GUAGGCUG CUGAUGA X GAA AAAUAUUU | 1605 |
| 5380 | AAUAUUUUC AGCCUACA | 783 | UGUAGGCU CUGAUGA X GAA AAAAUAUU | 1606 |
| 5386 | UUCAGCCUA CAGUUAUG | 784 | CAUAACUG CUGAUGA X GAA AGGCUGAA | 1607 |
| 5391 | CCUACAGUU AUGUUCAG | 785 | CUGAACAU CUGAUGA X GAA ACUGUAGG | 1608 |
| 5392 | CUACAGUUA UGUUCAGU | 786 | ACUGAACA CUGAUGA X GAA AACUGUAG | 1609 |
| 5396 | AGUUAUGUU CAGUCACA | 787 | UGUGACUG CUGAUGA X GAA ACAUAACU | 1610 |
| 5397 | GUUAUGUUC AGUCACAC | 788 | GUGUGACU CUGAUGA X GAA AACAUAAC | 1611 |
| 5401 | UGUUCAGUC ACACACAC | 789 | GUGUGUGU CUGAUGA X GAA ACUGAACA | 1612 |
| 5412 | ACACACAUA CAAAAUGU | 790 | ACAUUUUG CUGAUGA X GAA AUGUGUGU | 1613 |
| 5421 | CAAAAUGUU CCUUUUGC | 791 | GCAAAAGG CUGAUGA X GAA ACAUUUUG | 1614 |
| 5422 | AAAAUGUUC CUUUUGCU | 792 | AGCAAAAG CUGAUGA X GAA AACAUUUU | 1615 |
| 5425 | AUGUUCCUU UUGCUUUU | 793 | AAAAGCAA CUGAUGA X GAA AGGAACAU | 1616 |
| 5426 | UGUUCCUUU UGCUUUUA | 794 | UAAAAGCA CUGAUGA X GAA AAGGAACA | 1617 |
| 5427 | GUUCCUUUU GCUUUAA | 795 | UUAAAAGC CUGAUGA X GAA AAAGGAAC | 1618 |
| 5431 | CUUUUGCUU UUAAAGUA | 796 | UACUUUAA CUGAUGA X GAA AGCAAAAG | 1619 |
| 9432 | UUUUGCUUU UAAAGUAA | 797 | UUACUUUA CUGAUGA X GAA AAGCAAAA | 1620 |
| 5433 | UUUGCUUUU AAAGUAAU | 798 | AUUACUUU CUGAUGA X GAA AAAGCAAA | 1621 |
| 5434 | UUGCUUUUA AAGUAAUU | 799 | AAUUACUU CUGAUGA X GAA AAAAGCAA | 1622 |
| 5439 | UUUAAAGUA AUUUUUGA | 800 | UCAAAAAU CUGAUGA X GAA ACUUUAAA | 1623 |
| 5442 | AAAGUAAUU UUUGACUC | 801 | GAGUCAAA CUGAUGA X GAA AUUACUUU | 1624 |
| 5443 | AAGUAAUUU UUGACUCC | 802 | GGAGUCAA CUGAUGA X GAA AAUUACUU | 1625 |
| 5444 | AGUAAUUUU UGACUCCC | 803 | GGGAGUCA CUGAUGA X GAA AAAUUACU | 1626 |
| 5445 | GUAAUUUUU GACUCCCA | 804 | UGGGAGUC CUGAUGA X GAA AAAAUUAC | 1627 |
| 5450 | UUUUGACUC CCAGAUCA | 805 | UGAUCUGG CUGAUGA X GAA AGUCAAAA | 1628 |
| 5457 | UCCCAGAUC AGUCAGAG | 806 | CUCUGACU CUGAUGA X GAA AUCUGGGA | 1629 |
| 5461 | AGAUCAGUC AGAGCCCC | 807 | GGGGCUCU CUGAUGA X GAA ACUGAUCU | 1630 |
| 5471 | GAGCCCCUA CAGCAUUG | 808 | CAAUGCUG CUGAUGA X GAA AGGGGCUC | 1631 |
| 5478 | UACAGCAUU GUUAAGAA | 809 | UUCUUAAC CUGAUGA X GAA AUGCUGUA | 1632 |
| 5481 | AGCAUUGUU AAGAAAGU | 810 | ACUUUCUU CUGAUGA X GAA ACAAUGCU | 1633 |
| 5482 | GCAUUGUUA AGAAAGUA | 811 | UACUUUCU CUGAUGA X GAA AACAAUGC | 1634 |
| 5490 | AAGAAAGUA UUUGAUUU | 812 | AAAUCAAA CUGAUGA X GAA ACUUUCUU | 1635 |
| 5492 | GAAAGUAUU UGAUUUUU | 813 | AAAAAUCA CUGAUGA X GAA AUACUUUC | 1636 |
| 5493 | AAAGUAUUU GAUUUUUG | 814 | CAAAAAUC CUGAUGA X GAA AAUACUUU | 1637 |
| 5497 | UAUUUGAUU UUUGUCUC | 815 | GAGACAAA CUGAUGA X GAA AUCAAAUA | 1638 |
| 5498 | AUUUGAUUU UUGUCUCA | 816 | UGAGACAA CUGAUGA X GAA AAUCAAAU | 1639 |
| 5499 | UUUGAUUUU UGUCUCAA | 817 | UUGAGACA CUGAUGA X GAA AAAUCAAA | 1640 |
| 5500 | UUGAUUUUU GUCUCAAU | 818 | AUUGAGAC CUGAUGA X GAA AAAAUCAA | 1641 |
| 5503 | AUUUUGGUC UCAAUGAA | 819 | UUCAUUGA CUGAUGA X GAA ACAAAAAU | 1642 |
| 5505 | UUUUGUCUC AAUGAAAA | 820 | UUUUCAUU CUGAUGA X GAA AGACAAAA | 1643 |
| 5515 | AUGAAAAUA AAACUAUA | 821 | UAUAGUUU CUGAUGA X GAA AUUUUCAU | 1644 |
| 5521 | AUAAAACUA UAUUCAUU | 822 | AAUGAAUA CUGAUGA X GAA AGUUAAAU | 1645 |
| 5523 | AAACUAUA UUCAUUUC | 823 | GAAAUGAA CUGAUGA X GAA AUAGUUUU | 1646 |

Where "X" represents stem II region of a HH ribozyme (Hertel et al., 1992 Nucleic Acids Res. 20 3252). The length of stem II may be ≥2 base-pairs.

TABLE IV

Human EGF-R Hairpin Ribozyme and Target Sequence

| nt. Position | Ribozyme | Seq. ID NOs. | Substrate | Seq. ID NOs. |
|---|---|---|---|---|
| 38 | GGCGGC AGAA GCGC ACCAGAGAAACACACGUUGUGGUACAUUACCUGGUA | 1647 | GCGCC GCC GCCGCC | 1759 |
| 41 | CUCGGC AGAA GCGG ACCAGAGAAACACACGUUGUGGUACAUUACCUGGUA | 1648 | CCGCC GCC GCCCAG | 1760 |
| 44 | GGUCUG AGAA GCGG ACCAGAGAAACACACGUUGUGGUACAUUACCUGGUA | 1649 | CCGCC GCC CAGACC | 1761 |
| 49 | CGUCCG AGAA GGGC ACCAGAGAAACACACGUUGUGGUACAUUACCUGGUA | 1650 | GCCCA GAC CGGACG | 1762 |
| 54 | CCUGUC AGAA GGUC ACCAGAGAAACACACGUUGUGGUACAUUACCUGGUA | 1651 | GACCG GAC GACAGG | 1763 |
| 80 | GACUCG AGAA GACG ACCAGAGAAACACACGUUGUGGUACAUUACCUGGUA | 1652 | CGUCC GCC CGAGUC | 1764 |
| 92 | CGGGCA AGAA GGGA ACCAGAGAAACACACGUUGUGGUACAUUACCUGGUA | 1653 | UCCCC GCC UCGCCG | 1765 |
| 125 | UCAGGG AGAA GUGC ACCAGAGAAACACACGUUGUGGUACAUUACCUGGUA | 1654 | GCACG GCC CCCUGA | 1766 |

TABLE IV-continued

Human EGF-R Hairpin Ribozyme and Target Sequence

| nt. Position | Ribozyme | Seq. ID NOs. | Substrate | Seq. ID NOs. |
|---|---|---|---|---|
| 132 | GACGGA AGAA GGGG ACCAGAGAAACACACGUUGUGGUACAUUACCUGGUA | 1655 | CCCCU GAC UCCGUC | 1767 |
| 138 | AUACUG AGAA GAGU ACCAGAGAAACACACGUUGUGGUACAUUACCUGGUA | 1656 | ACUCC GUC CAGUAU | 1768 |
| 204 | UGCCCC AGAA GUCC ACCAGAGAAACACACGUUGUGGUACAUUACCUGGUA | 1657 | GGACG GCC GGGGCA | 1769 |
| 227 | GCAGCC AGAA GCGC ACCAGAGAAACACACGUUGUGGUACAUUACCUGGUA | 1658 | GCGCU GCU GGCUGC | 1770 |
| 241 | UCGCCG AGAA GAGC ACCAGAGAAACACACGUUGUGGUACAUUACCUGGUA | 1659 | GCUCU GCC CGGCGA | 1771 |
| 305 | GUGCCC AGAA GCGU ACCAGAGAAACACACGUUGUGGUACAUUACCUGGUA | 1660 | ACGCA GUU GGGCAC | 1772 |
| 334 | UCUGGA AGAA GAGA ACCAGAGAAACACACGUUGUGGUACAUUACCUGGUA | 1661 | UCUCA GCC UCCAGA | 1773 |
| 500 | CUGAUG AGAA GCAG ACCAGAGAAACACACGUUGUGGUACAUUACCUGGUA | 1662 | CUGCA GAU CAUCAG | 1774 |
| 546 | AGAUAA AGAA GCUA ACCAGAGAAACACACGUUGUGGUACAUUACCUGGUA | 1663 | UAGCA GUC UUAUCU | 1775 |
| 577 | CCUUCA AGAA GGUU ACCAGAGAAACACACGUUGUGGUACAUUACCUGGUA | 1664 | AACCG GAC UGAAGG | 1776 |
| 590 | CUCAUG AGAA GCUC ACCAGAGAAACACACGUUGUGGUACAUUACCUGGUA | 1665 | GAGCU GCC CAUGAG | 1777 |
| 632 | UUGCUG AGAA GCAC ACCAGAGAAACACACGUUGUGGUACAUUACCUGGUA | 1666 | GUGCG GUU CAGCAA | 1778 |
| 648 | GCACAG AGAA GGGU ACCAGAGAAACACACGUUGUGGUACAUUACCUGGUA | 1667 | ACCCU GCC CUGUGC | 1779 |
| 742 | UUUGGC AGAA GCCC ACCAGAGAAACACACGUUGUGGUACAUUACCUGGUA | 1668 | GGGCA GCU GCCAAA | 1780 |
| 766 | CAUUGG AGAA GCUU ACCAGAGAAACACACGUUGUGGUACAUUACCUGGUA | 1669 | AAGCU GUC CCAAUG | 1781 |
| 781 | CACCCC AGAA GCUC ACCAGAGAAACACACGUUGUGGUACAUUACCUGGUA | 1670 | GAGCU GCU GGGGUG | 1782 |
| 815 | AUUUUG AGAA GUUU ACCAGAGAAACACACGUUGUGGUACAUUACCUGGUA | 1671 | AAACU GAC CAAAAU | 1783 |
| 853 | UGCCAC AGAA GCGC ACCAGAGAAACACACGUUGUGGUACAUUACCUGGUA | 1672 | GCGCU GCC GUGGCA | 1784 |
| 877 | UGUGGC AGAA GUCA ACCAGAGAAACACACGUUGUGGUACAUUACCUGGUA | 1673 | UGACU GCU GCCACA | 1785 |
| 928 | AGACCA AGAA GUCG ACCAGAGAAACACACGUUGUGGUACAUUACCUGGUA | 1674 | CGACU GCC UGGUCU | 1786 |
| 937 | AUUUGC AGAA GACC ACCAGAGAAACACACGUUGUGGUACAUUACCUGGUA | 1675 | GGUCU GCC GCAAAU | 1787 |
| 976 | GUGGGG AGAA GGUG ACCAGAGAAACACACGUUGUGGUACAUUACCUGGUA | 1676 | CACCU GCC CCCCAC | 1788 |
| 1013 | ACAUCC AGAA GGUA ACCAGAGAAACACACGUUGUGGUACAUUACCUGGUA | 1677 | UACCA GAU GGAUGU | 1789 |
| 1042 | CACCAA AGAA GUAU ACCAGAGAAACACACGUUGUGGUACAUUACCUGGUA | 1678 | AUACA GCU UUGGUG | 1790 |
| 1092 | GCCGUG AGAA GUCA ACCAGAGAAACACACGUUGUGGUACAUUACCUGGUA | 1679 | UGACA GAU CACGGC | 1791 |
| 1099 | CGCACG AGAA GUGA ACCAGAGAAACACACGUUGUGGUACAUUACCUGGUA | 1680 | UCACG GCU CGUGCG | 1792 |
| 1301 | GCCACC AGAA GGAU ACCAGAGAAACACACGUUGUGGUACAUUACCUGGUA | 1681 | AUCCU GCC GGUGGC | 1793 |
| 1403 | GCCUGA AGAA GCAA ACCAGAGAAACACACGUUGUGGUACAUUACCUGGUA | 1682 | UUGCU GAU UCAGGC | 1794 |
| 1431 | AUGGAG AGAA GUCC ACCAGAGAAACACACGUUGUGGUACAUUACCUGGUA | 1683 | GGACG GAC CUCCAU | 1795 |
| 1490 | AGAGAA AGAA GACC ACCAGAGAAACACACGUUGUGGUACAUUACCUGGUA | 1684 | GGUCA GUU UUCUCU | 1796 |
| 1503 | GCUGAC AGAA GCAA ACCAGAGAAACACACGUUGUGGUACAUUACCUGGUA | 1685 | UUGCA GUC GUCAGC | 1797 |
| 1510 | UGUUCA AGAA GACG ACCAGAGAAACACACGUUGUGGUACAUUACCUGGUA | 1686 | CGUCA GCC UGAACA | 1798 |
| 1625 | GUCCCA AGAA GUUU ACCAGAGAAACACACGUUGUGGUACAUUACCUGGUA | 1687 | AAACU GUU UGGGAC | 1799 |
| 1678 | CCUUGC AGAA GUUU ACCAGAGAAACACACGUUGUGGUACAUUACCUGGUA | 1688 | AAACA GCU GCAAGG | 1800 |
| 1729 | GGCCCC AGAA GCCC ACCAGAGAAACACACGUUGUGGUACAUUACCUGGUA | 1689 | GGGCU GCU GGGGCC | 1801 |
| 1774 | UGCCUC AGAA GACA ACCAGAGAAACACACGUUGUGGUACAUUACCUGGUA | 1690 | UGUCA GCC GAGGCA | 1802 |
| 1874 | GCCUGA AGAA GGCA ACCAGAGAAACACACGUUGUGGUACAUUACCUGGUA | 1691 | UGCCU GCC UCAGGC | 1803 |
| 1948 | AGUGGG AGAA GUCA ACCAGAGAAACACACGUUGUGGUACAUUACCUGGUA | 1692 | UGACG GCC CCCACU | 1804 |
| 1969 | CUGCCG AGAA GGUC ACCAGAGAAACACACGUUGUGGUACAUUACCUGGUA | 1693 | GACCU GCC CGGCAG | 1805 |
| 2019 | GCCGGC AGAA GCGU ACCAGAGAAACACACGUUGUGGUACAUUACCUGGUA | 1694 | ACGCA GAC GCCGGC | 1806 |
| 2065 | CAGUGC AGAA GUAG ACCAGAGAAACACACGUUGUGGUACAUUACCUGGUA | 1695 | CUACG GAU GCACUG | 1807 |
| 2092 | UCGUUG AGAA GCCU ACCAGAGAAACACACGUUGUGGUACAUUACCUGGUA | 1696 | AGGCU GUC CAACGA | 1808 |
| 2117 | GCGAUG AGAA GGAU ACCAGAGAAACACACGUUGUGGUACAUUACCUGGUA | 1697 | AUCCC GUC CAUCGC | 1809 |
| 2156 | ACCACC AGAA GCAA ACCAGAGAAACACACGUUGUGGUACAUUACCUGGUA | 1698 | UUGCU GCU GGUGGU | 1810 |
| 2179 | UGAAGA AGAA GAUC ACCAGAGAAACACACGUUGUGGUACAUUACCUGGUA | 1699 | GAUCG GCC UCUUCA | 1811 |
| 2231 | UCCUGC AGAA GCCU ACCAGAGAAACACACGUUGUGGUACAUUACCUGGUA | 1700 | AGGCU GCU GCAGGA | 1812 |
| 2409 | GAUAGC AGAA GGAA ACCAGAGAAACACACGUUGUGGUACAUUACCUGGUA | 1701 | UUCCC GUC GCUAUC | 1813 |
| 2512 | CCAGCA AGAA GCAC ACCAGAGAAACACACGUUGUGGUACAUUACCUGGUA | 1702 | GUGCC GCC UGCUGG | 1814 |
| 2516 | AUGCCC AGAA GGCG ACCAGAGAAACACACGUUGUGGUACAUUACCUGGUA | 1703 | CGCCU GCU GGGGAU | 1815 |
| 2527 | AGGUGA AGAA GAUG ACCAGAGAAACACACGUUGUGGUACAUUACCUGGUA | 1704 | CAUCU GCC UCACCU | 1816 |
| 2558 | GGCAUG AGAA GCGU ACCAGAGAAACACACGUUGUGGUACAUUACCUGGUA | 1705 | ACGCA GCU CAUGCC | 1817 |
| 2572 | GGAGGC AGAA GAAG ACCAGAGAAACACACGUUGUGGUACAUUACCUGGUA | 1706 | CUUCG GCU GCCUCC | 1818 |
| 2575 | CCAGGA AGAA GCCG ACCAGAGAAACACACGUUGUGGUACAUUACCUGGUA | 1707 | CGGCU GCC UCCUGG | 1819 |
| 2627 | CAGUUG AGAA GGUA ACCAGAGAAACACACGUUGUGGUACAUUACCUGGUA | 1708 | UACCU GCU CAACUG | 1820 |
| 2645 | UUUGCG AGAA GCAC ACCAGAGAAACACACGUUGUGGUACAUUACCUGGUA | 1709 | GUGCA GAU CGCAAA | 1821 |
| 2677 | CCAAGC AGAA GUCC ACCAGAGAAACACACGUUGUGGUACAUUACCUGGUA | 1710 | GGACC GUC GCUUGG | 1822 |
| 2748 | CCCAAA AGAA GUGA ACCAGAGAAACACACGUUGUGGUACAUUACCUGGUA | 1711 | UCACA GAU UUUGGG | 1823 |
| 2768 | GCACCC AGAA GUUU ACCAGAGAAACACACGUUGUGGUACAUUACCUGGUA | 1712 | AAACU GCU GGGUGC | 1824 |
| 2895 | CUCCCA AGAA GUCA ACCAGAGAAACACACGUUGUGGUACAUUACCUGGUA | 1713 | UGACC GUU UGGGAG | 1825 |
| 3165 | GUUGGA AGAA GUAG ACCAGAGAAACACACGUUGUGGUACAUUACCUGGUA | 1714 | CUACA GAC UCCAAC | 1826 |
| 3188 | UCAUCC AGAA GGGC ACCAGAGAAACACACGUUGUGGUACAUUACCUGGUA | 1715 | GCCCU GAU GGAUGA | 1827 |
| 3225 | GUACUC AGAA GCAU ACCAGAGAAACACACGUUGUGGUACAUUACCUGGUA | 1716 | AUGCC GAC GAGUAC | 1828 |
| 3262 | UGGAGG AGAA GCUG ACCAGAGAAACACACGUUGUGGUACAUUACCUGGUA | 1717 | CAGCA GCC CCUCCA | 1829 |
| 3278 | AGGGGA AGAA GUGA ACCAGAGAAACACACGUUGUGGUACAUUACCUGGUA | 1718 | UCACG GAC UCCCCU | 1830 |
| 3358 | UGAUGG AGAA GCUU ACCAGAGAAACACACGUUGUGGUACAUUACCUGGUA | 1719 | AAGCU GUC CCAUCA | 1831 |
| 3376 | GCAAGA AGAA GUCU ACCAGAGAAACACACGUUGUGGUACAUUACCUGGUA | 1720 | AGACA GCU UCUGGC | 1832 |
| 3394 | GGUCUG AGAA GUAU ACCAGAGAAACACACGUUGUGGUACAUUACCUGGUA | 1721 | AUACA GCU CAGACC | 1833 |
| 3399 | UGUGGG AGAA GAGC ACCAGAGAAACACACGUUGUGGUACAUUACCUGGUA | 1722 | GCUCA GAC CCCACA | 1834 |
| 3470 | GGAACG AGAA GGUU ACCAGAGAAACACACGUUGUGGUACAUUACCUGGUA | 1723 | AACCA GCU CGUUCC | 1835 |
| 3474 | UUUGGG AGAA GACU ACCAGAGAAACACACGUUGUGGUACAUUACCUGGUA | 1724 | AGUCC GUU CCCAAA | 1836 |
| 3489 | AGAGCC AGAA GGCC ACCAGAGAAACACACGUUGUGGUACAUUACCUGGUA | 1725 | GGCCC GCU GGCUCU | 1837 |
| 3510 | GUGAUA AGAA GGAU ACCAGAGAAACACACGUUGUGGUACAUUACCUGGUA | 1726 | AUCCU GUC UAUCAC | 1838 |
| 3524 | UUCAGA AGAA GAUU ACCAGAGAAACACACGUUGUGGUACAUUACCUGGUA | 1727 | AAUCA GCC UCUGAA | 1839 |
| 3609 | GGGCUG AGAA GUGU ACCAGAGAAACACACGUUGUGGUACAUUACCUGGUA | 1728 | ACACU GUC CAGCCC | 1840 |

TABLE IV-continued

Human EGF-R Hairpin Ribozyme and Target Sequence

| nt. Position | Ribozyme | Seq. ID NOs. | Substrate | Seq. ID NOs. |
|---|---|---|---|---|
| 3614 | CAGGUG AGAA GGAC ACCAGAGAAACACACGUUGUGGUACAUUACCUGGUA | 1729 | GUCCA GCC CACCUG | 1841 |
| 3643 | GGGCAG AGAA GUCG ACCAGAGAAACACACGUUGUGGUACAUUACCUGGUA | 1730 | CGACA GCC CUGCCC | 1842 |
| 3648 | CCAGUG AGAA GGGC ACCAGAGAAACACACGUUGUGGUACAUUACCUGGUA | 1731 | GCCCU GCC CACUGG | 1843 |
| 3696 | CUGGUA AGAA GGGU ACCAGAGAAACACACGUUGUGGUACAUUACCUGGUA | 1732 | ACCCU GAC UACCAG | 1844 |
| 3759 | AUUUUC AGAA GUGG ACCAGAGAAACACACGUUGUGGUACAUUACCUGGUA | 1733 | CCACA GCU GAAAAU | 1845 |
| 3851 | GAAAGA AGAA GGAU ACCAGAGAAACACACGUUGUGGUACAUUACCUGGUA | 1734 | AUCCA GAC UCUUUC | 1846 |
| 3931 | AAACCA AGAA GUGG ACCAGAGAAACACACGUUGUGGUACAUUACCUGGUA | 1735 | CCACA GAC UGGUUU | 1847 |
| 3955 | UGGCUA AGAA GUGU ACCAGAGAAACACACGUUGUGGUACAUUACCUGGUA | 1736 | ACACC GAC UAGCCA | 1848 |
| 4310 | CCUUGA AGAA GAAC ACCAGAGAAACACACGUUGUGGUACAUUACCUGGUA | 1737 | GUUCU GCU UCAAGG | 1849 |
| 4374 | GUACCG AGAA GGCC ACCAGAGAAACACACGUUGUGGUACAUUACCUGGUA | 1738 | GGCCG GAU CGGUAC | 1850 |
| 4423 | GGAAGG AGAA GAGU ACCAGAGAAACACACGUUGUGGUACAUUACCUGGUA | 1739 | ACUCU GUC CCUUCC | 1851 |
| 4514 | UGGUCC AGAA GUGG ACCAGAGAAACACACGUUGUGGUACAUUACCUGGUA | 1740 | CCACU GAU GGACCA | 1852 |
| 4550 | AAACAA AGAA GUCU ACCAGAGAAACACACGUUGUGGUACAUUACCUGGUA | 1741 | AGACU GAC UUGUUU | 1853 |
| 4594 | GACAGG AGAA GCAU ACCAGAGAAACACACGUUGUGGUACAUUACCUGGUA | 1742 | AUGCC GCC CCUGUC | 1854 |
| 4600 | CAGCAA AGAA GGGG ACCAGAGAAACACACGUUGUGGUACAUUACCUGGUA | 1743 | CCCCU GUC UUGCUG | 1855 |
| 4653 | GCUGGA AGAA GAGU ACCAGAGAAACACACGUUGUGGUACAUUACCUGGUA | 1744 | ACUCG GAU UCCAGC | 1856 |
| 4660 | AAUGUG AGAA GGAA ACCAGAGAAACACACGUUGUGGUACAUUACCUGGUA | 1745 | UUCCA GCC CACAUU | 1857 |
| 4701 | AUUCUC AGAA GUGG ACCAGAGAAACACACGUUGUGGUACAUUACCUGGUA | 1746 | CCACA GCU GAGAAU | 1858 |
| 4733 | AACAAA AGAA GUGU ACCAGAGAAACACACGUUGUGGUACAUUACCUGGUA | 1747 | ACACC GCU UUUGUU | 1859 |
| 4775 | CAUUUC AGAA GAGC ACCAGAGAAACACACGUUGUGGUACAUUACCUGGUA | 1748 | GCUCA GAU GAAAUG | 1860 |
| 4831 | UUUCAG AGAA GCUU ACCAGAGAAACACACGUUGUGGUACAUUACCUGGUA | 1749 | AAGCU GCU CUGAAA | 1861 |
| 4962 | GGGGGC AGAA GACC ACCAGAGAAACACACGUUGUGGUACAUUACCUGGUA | 1750 | GGUCA GCU GCCCCC | 1862 |
| 4965 | UUUGGG AGAA GCUG ACCAGAGAAACACACGUUGUGGUACAUUACCUGGUA | 1751 | CAGCU GCC CCCAAA | 1863 |
| 5011 | ACUCAA AGAA GAGA ACCAGAGAAACACACGUUGUGGUACAUUACCUGGUA | 1752 | UCUCU GCC UUGAGU | 1864 |
| 5040 | GGCCAG AGAA GUAA ACCAGAGAAACACACGUUGUGGUACAUUACCUGGUA | 1753 | UUACA GCU CUGGCC | 1865 |
| 5161 | UAAAAC AGAA GCAA ACCAGAGAAACACACGUUGUGGUACAUUACCUGGUA | 1754 | UUGCA GAU GUUUUA | 1866 |
| 5277 | UAACCA AGAA GGUU ACCAGAGAAACACACGUUGUGGUACAUUACCUGGUA | 1755 | AACCU GAC UGGUUA | 1867 |
| 5292 | ACAAAG AGAA GCUG ACCAGAGAAACACACGUUGUGGUACAUUACCUGGUA | 1756 | CAGCA GUC CUUUGU | 1868 |
| 5381 | ACUGUA AGAA GAAA ACCAGAGAAACACACGUUGUGGUACAUUACCUGGUA | 1757 | UUUCA GCC UACAGU | 1869 |
| 5453 | UGACUG AGAA GGGA ACCAGAGAAACACACGUUGUGGUACAUUACCUGGUA | 1758 | UCCCA GAU CAGUCA | 1870 |

SEQUENCE LISTING (1877 sequences)

SEQ ID NO: 1 - DNA, 17 bp; single-stranded, linear
gccggagucccgagcua

SEQ ID NO: 2 - DNA, 17 bp; single-stranded, linear
cccgagcuagccccggc

SEQ ID NO: 3 - DNA, 17 bp; single-stranded, linear
ggccaccucgucggcgu

SEQ ID NO: 4 - DNA, 17 bp; single-stranded, linear
caccucgucggcguccg

SEQ ID NO: 5 - DNA, 17 bp; single-stranded, linear
gucggcguccgcccgag

SEQ ID NO: 6 - DNA, 17 bp; single-stranded, linear
gcccgaguccccgccuc

SEQ ID NO: 7 - DNA, 17 bp; single-stranded, linear
ccccgccucgccgccaa

SEQ ID NO: 8 - DNA, 17 bp; single-stranded, linear
cccugacuccguccagu

SEQ ID NO: 9 - DNA, 17 bp; single-stranded, linear
gacuccguccaguauug

SEQ ID NO: 10 - DNA, 17 bp; single-stranded, linear
cguccaguauugaucgg

SEQ ID NO: 11 - DNA, 17 bp; single-stranded, linear
uccaguauugaucggga

SEQ ID NO: 12 - DNA, 17 bp; single-stranded, linear
guauugaucgggagagc

SEQ ID NO: 13 - DNA, 17 bp; single-stranded, linear
agcgagcucuucgggga

SEQ ID NO: 14 - DNA, 17 bp; single-stranded, linear
cgagcucuucggggagc

SEQ ID NO: 15 - DNA, 17 bp; single-stranded, linear
gagcucuucggggagca

SEQ ID NO: 16 - DNA, 17 bp; single-stranded, linear
gcgacccuccgggacgg

SEQ ID NO: 17 - DNA, 17 bp; single-stranded, linear
gcagcgcuccuggcgcu

SEQ ID NO: 18 - DNA, 17 bp; single-stranded, linear
gcugcgcucugcccggc

SEQ ID NO: 19 - DNA, 17 bp; single-stranded, linear
cggcgagucgggcucug

SEQ ID NO: 20 - DNA, 17 bp; single-stranded, linear
gucgggcucuggaggaa

SEQ ID NO: 21 - DNA, 17 bp; single-stranded, linear
aagaaaguuugccaagg

SEQ ID NO: 22 - DNA, 17 bp; single-stranded, linear
agaaaguuugccaaggc

SEQ ID NO: 23 - DNA, 17 bp; single-stranded, linear
gcacgaguaacaagcuc

SEQ ID NO: 24 - DNA, 17 bp; single-stranded, linear
aacaagcucacgcaguu

SEQ ID NO: 25 - DNA, 17 bp; single-stranded, linear
cacgcaguugggcacuu

SEQ ID NO: 26 - DNA, 17 bp; single-stranded, linear
ugggcacuuuugaagau

SEQ ID NO: 27 - DNA, 17 bp; single-stranded, linear
gggcacuuuugaagauc

SEQ ID NO: 28 - DNA, 17 bp; single-stranded, linear
ggcacuuuugaagauca

SEQ ID NO: 29 - DNA, 17 bp; single-stranded, linear
uugaagaucauuuucuc

SEQ ID NO: 30 - DNA, 17 bp; single-stranded, linear
aagaucauuuucucagc

SEQ ID NO: 31 - DNA, 17 bp; single-stranded, linear
agaucauuuucucagcc

SEQ ID NO: 32 - DNA, 17 bp; single-stranded, linear
gaucauuuucucagccu

SEQ ID NO: 33 - DNA, 17 bp; single-stranded, linear
aucauuuucucagccuc

SEQ ID NO: 34 - DNA, 17 bp; single-stranded, linear
cauuuucucagccucca

SEQ ID NO: 35 - DNA, 17 bp; single-stranded, linear
cucagccuccagaggau

SEQ ID NO: 36 - DNA, 17 bp; single-stranded, linear
gaggauguucaauaacu

SEQ ID NO: 37 - DNA, 17 bp; single-stranded, linear
aggauguucaauaacug

SEQ ID NO: 38 - DNA, 17 bp; single-stranded, linear
uguucaauaacugugag

SEQ ID NO: 39 - DNA, 17 bp; single-stranded, linear
gaggugguccuugggaa

SEQ ID NO: 40 - DNA, 17 bp; single-stranded, linear
gugguccuugggaauuu

SEQ ID NO: 41 - DNA, 17 bp; single-stranded, linear
uugggaauuuggaaauu

SEQ ID NO: 42 - DNA, 17 bp; single-stranded, linear
ugggaauuuggaaauua

SEQ ID NO: 43 - DNA, 17 bp; single-stranded, linear
uuggaaauuaccuaugu

SEQ ID NO: 44 - DNA, 17 bp; single-stranded, linear
uggaaauuaccuaugug

SEQ ID NO: 45 - DNA, 17 bp; single-stranded, linear
aauuaccuaugugcaga

SEQ ID NO: 46 - DNA, 17 bp; single-stranded, linear
agaggaauuaugaucuu

SEQ ID NO: 47 - DNA, 17 bp; single-stranded, linear
gaggaauuaugaucuuu

SEQ ID NO: 48 - DNA, 17 bp; single-stranded, linear
auuaugaucuuuccuuc

SEQ ID NO: 49 - DNA, 17 bp; single-stranded, linear
uaugaucuuuccuucuu

SEQ ID NO: 50 - DNA, 17 bp; single-stranded, linear
augaucuuuccuucuua

SEQ ID NO: 51 - DNA, 17 bp; single-stranded, linear
ugaucuuuccuucuuaa

SEQ ID NO: 52 - DNA, 17 bp; single-stranded, linear
ucuuuccuucuuaaaga

SEQ ID NO: 53 - DNA, 17 bp; single-stranded, linear
cuuuccuucuuaaagac

SEQ ID NO: 54 - DNA, 17 bp; single-stranded, linear
uuccuucuuaaagacca

SEQ ID NO: 55 - DNA, 17 bp; single-stranded, linear
uccuucuuaaagaccau

SEQ ID NO: 56 - DNA, 17 bp; single-stranded, linear
aagaccauccaggaggu

SEQ ID NO: 57 - DNA, 17 bp; single-stranded, linear
uggcugguuauguccuc

SEQ ID NO: 58 - DNA, 17 bp; single-stranded, linear
ggcugguuauguccuca

SEQ ID NO: 59 - DNA, 17 bp; single-stranded, linear
gguuauguccucauugc

SEQ ID NO: 60 - DNA, 17 bp; single-stranded, linear
uauguccucauugcccu

SEQ ID NO: 61 - DNA, 17 bp; single-stranded, linear
guccucauugcccucaa

SEQ ID NO: 62 - DNA, 17 bp; single-stranded, linear
auugcccucaacacagu

SEQ ID NO: 63 - DNA, 17 bp; single-stranded, linear
gagcgaauuccuuugga

SEQ ID NO: 64 - DNA, 17 bp; single-stranded, linear
agcgaauuccuuuggaa

SEQ ID NO: 65 - DNA, 17 bp; single-stranded, linear
gaauuccuuuggaaaac

SEQ ID NO: 66 - DNA, 17 bp; single-stranded, linear
aauuccuuuggaaaacc

SEQ ID NO: 67 - DNA, 17 bp; single-stranded, linear
cugcagaucaucagagg

SEQ ID NO: 68 - DNA, 17 bp; single-stranded, linear
cagaucaucagaggaaa

SEQ ID NO: 69 - DNA, 17 bp; single-stranded, linear
gaggaaauauguacuac

SEQ ID NO: 70 - DNA, 17 bp; single-stranded, linear
aaauauguacuacgaaa

SEQ ID NO: 71 - DNA, 17 bp; single-stranded, linear
uauguacuacgaaaauu

SEQ ID NO: 72 - DNA, 17 bp; single-stranded, linear
acgaaaauuccuaugcc

SEQ ID NO: 73 - DNA, 17 bp; single-stranded, linear
cgaaaauuccuaugccu

SEQ ID NO: 74 - DNA, 17 bp; single-stranded, linear
aaauuccuaugccuuag

SEQ ID NO: 75 - DNA, 17 bp; single-stranded, linear
cuaugccuuagcagucu

SEQ ID NO: 76 - DNA, 17 bp; single-stranded, linear
uaugccuuagcagucuu

SEQ ID NO: 77 - DNA, 17 bp; single-stranded, linear
uuagcagucuuaucuaa

SEQ ID NO: 78 - DNA, 17 bp; single-stranded, linear
agcagucuuaucuaacu

SEQ ID NO: 79 - DNA, 17 bp; single-stranded, linear
gcagucuuaucuaacua

SEQ ID NO: 80 - DNA, 17 bp; single-stranded, linear
agucuuaucuaacuaug

SEQ ID NO: 81 - DNA, 17 bp; single-stranded, linear
ucuuaucuaacuaugau

SEQ ID NO: 82 - DNA, 17 bp; single-stranded, linear
aucuaacuaugaugcaa

SEQ ID NO: 83 - DNA, 17 bp; single-stranded, linear
augcaaauaaaaccgga

SEQ ID NO: 84 - DNA, 17 bp; single-stranded, linear
ugagaaauuuacaggaa

SEQ ID NO: 85 - DNA, 17 bp; single-stranded, linear
gagaaauuuacaggaaa

SEQ ID NO: 86 - DNA, 17 bp; single-stranded, linear
agaaauuuacaggaaau

SEQ ID NO: 87 - DNA, 17 bp; single-stranded, linear
caggaaauccugcaugg

SEQ ID NO: 88 - DNA, 17 bp; single-stranded, linear
cgugcgguucagcaaca

SEQ ID NO: 89 - DNA, 17 bp; single-stranded, linear
gugcgguucagcaacaa

SEQ ID NO: 90 - DNA, 17 bp; single-stranded, linear
gagagcauccaguggcg

SEQ ID NO: 91 - DNA, 17 bp; single-stranded, linear
cgggacauagucagcag

SEQ ID NO: 92 - DNA, 17 bp; single-stranded, linear
gacauagucagcaguga

SEQ ID NO: 93 - DNA, 17 bp; single-stranded, linear
cagugacuuucucagca

SEQ ID NO: 94 - DNA, 17 bp; single-stranded, linear
agugacuuucucagcaa

SEQ ID NO: 95 - DNA, 17 bp; single-stranded, linear
gugacuuucucagcaac

SEQ ID NO: 96 - DNA, 17 bp; single-stranded, linear
gacuuucucagcaacau

SEQ ID NO: 97 - DNA, 17 bp; single-stranded, linear
caacaugucgauggacu

SEQ ID NO: 98 - DNA, 17 bp; single-stranded, linear
gauggacuuccagaacc

SEQ ID NO: 99 - DNA, 17 bp; single-stranded, linear
auggacuuccagaacca

SEQ ID NO: 100 - DNA, 17 bp; single-stranded, linear
agugugauccaagcugu

SEQ ID NO: 101 - DNA, 17 bp; single-stranded, linear
caagcugucccaauggg

SEQ ID NO: 102 - DNA, 17 bp; single-stranded, linear
accaaaaucaucugugc

SEQ ID NO: 103 - DNA, 17 bp; single-stranded, linear
aaaaucaucugugccca

SEQ ID NO: 104 - DNA, 17 bp; single-stranded, linear
gcagugcuccgggcgcu

SEQ ID NO: 105 - DNA, 17 bp; single-stranded, linear
uggcaagucccccagug

SEQ ID NO: 106 - DNA, 17 bp; single-stranded, linear
ugccuggucugccgcaa

SEQ ID NO: 107 - DNA, 17 bp; single-stranded, linear
ccgcaaauuccgagacg

SEQ ID NO: 108 - DNA, 17 bp; single-stranded, linear
cgcaaauuccgagacga

SEQ ID NO: 109 - DNA, 17 bp; single-stranded, linear
cccccacucaugcucua

SEQ ID NO: 110 - DNA, 17 bp; single-stranded, linear
cucaugcucuacaaccc

SEQ ID NO: 111 - DNA, 17 bp; single-stranded, linear
caugcucuacaacccca

SEQ ID NO: 112 - DNA, 17 bp; single-stranded, linear
caccacguaccagaugg

SEQ ID NO: 113 - DNA, 17 bp; single-stranded, linear
gggcaaauacagcuuug

SEQ ID NO: 114 - DNA, 17 bp; single-stranded, linear
auacagcuuuggugcca

SEQ ID NO: 115 - DNA, 17 bp; single-stranded, linear
uacagcuuuggugccac

SEQ ID NO: 116 - DNA, 17 bp; single-stranded, linear
agaaguguccccguaau

SEQ ID NO: 117 - DNA, 17 bp; single-stranded, linear
guccccguaauuaugug

SEQ ID NO: 118 - DNA, 17 bp; single-stranded, linear
cccguaauuauguggug

SEQ ID NO: 119 - DNA, 17 bp; single-stranded, linear
ccguaauuaugugguga

SEQ ID NO: 120 - DNA, 17 bp; single-stranded, linear
ugacagaucacggcucg

SEQ ID NO: 121 - DNA, 17 bp; single-stranded, linear
ucacggcucgugcgucc

SEQ ID NO: 122 - DNA, 17 bp; single-stranded, linear
ucgugcguccgagccug

SEQ ID NO: 123 - DNA, 17 bp; single-stranded, linear
cgacagcuaugagaugg

SEQ ID NO: 124 - DNA, 17 bp; single-stranded, linear
gacggcguccgcaagug

SEQ ID NO: 125 - DNA, 17 bp; single-stranded, linear
gcaaguguaagaagugc

SEQ ID NO: 126 - DNA, 17 bp; single-stranded, linear
aagggccuugccgcaaa

SEQ ID NO: 127 - DNA, 17 bp; single-stranded, linear
aaguguguaacggaaua

SEQ ID NO: 128 - DNA, 17 bp; single-stranded, linear
aacggaauagguauugg

SEQ ID NO: 129 - DNA, 17 bp; single-stranded, linear
gaauagguauuggugaa

SEQ ID NO: 130 - DNA, 17 bp; single-stranded, linear
auagguauuggugaauu

SEQ ID NO: 131 - DNA, 17 bp; single-stranded, linear
uggugaauuuaaagacu

SEQ ID NO: 132 - DNA, 17 bp; single-stranded, linear
ggugaauuuaaagacuc

SEQ ID NO: 133 - DNA, 17 bp; single-stranded, linear
gugaauuuaaagacuca

SEQ ID NO: 134 - DNA, 17 bp; single-stranded, linear
uaaagacucacucucca

SEQ ID NO: 135 - DNA, 17 bp; single-stranded, linear
gacucacucuccauaaa

SEQ ID NO: 136 - DNA, 17 bp; single-stranded, linear
cucacucuccauaaaug

SEQ ID NO: 137 - DNA, 17 bp; single-stranded, linear
cucuccauaaaugcuac

SEQ ID NO: 138 - DNA, 17 bp; single-stranded, linear
uaaaugcuacgaauauu

SEQ ID NO: 139 - DNA, 17 bp; single-stranded, linear
cuacgaauauuaaacac

SEQ ID NO: 140 - DNA, 17 bp; single-stranded, linear
acgaauauuaaacacuu

SEQ ID NO: 141 - DNA, 17 bp; single-stranded, linear
cgaauauuaaacacuuc

SEQ ID NO: 142 - DNA, 17 bp; single-stranded, linear
uaaacacuucaaaaacu

SEQ ID NO: 143 - DNA, 17 bp; single-stranded, linear
aaacacuucaaaaacug

SEQ ID NO: 144 - DNA, 17 bp; single-stranded, linear
cugcaccuccaucagug

SEQ ID NO: 145 - DNA, 17 bp; single-stranded, linear
accuccaucaguggcga

SEQ ID NO: 146 - DNA, 17 bp; single-stranded, linear
guggcgaucuccacauc

SEQ ID NO: 147 - DNA, 17 bp; single-stranded, linear
ggcgaucuccacauccu

SEQ ID NO: 148 - DNA, 17 bp; single-stranded, linear
cuccacauccugccggu

SEQ ID NO: 149 - DNA, 17 bp; single-stranded, linear
gguggcauuuaggggug

SEQ ID NO: 150 - DNA, 17 bp; single-stranded, linear
guggcauuuagggguga

SEQ ID NO: 151 - DNA, 17 bp; single-stranded, linear
uggcauuuaggggugac

SEQ ID NO: 152 - DNA, 17 bp; single-stranded, linear
gggugacuccuucacac

SEQ ID NO: 153 - DNA, 17 bp; single-stranded, linear
ugacuccuucacacaua

SEQ ID NO: 154 - DNA, 17 bp; single-stranded, linear
gacuccuucacacauac

SEQ ID NO: 155 - DNA, 17 bp; single-stranded, linear
ucacacauacuccuccu

SEQ ID NO: 156 - DNA, 17 bp; single-stranded, linear
cacauacuccuccucug

SEQ ID NO: 157 - DNA, 17 bp; single-stranded, linear
auacuccuccucuggau

SEQ ID NO: 158 - DNA, 17 bp; single-stranded, linear
cuccuccucuggaucca

SEQ ID NO: 159 - DNA, 17 bp; single-stranded, linear
cucuggauccacaggaa

SEQ ID NO: 160 - DNA, 17 bp; single-stranded, linear
aacuggauauucugaaa

SEQ ID NO: 161 - DNA, 17 bp; single-stranded, linear
cuggauauucugaaaac

SEQ ID NO: 162 - DNA, 17 bp; single-stranded, linear
uggauauucugaaaacc

SEQ ID NO: 163 - DNA, 17 bp; single-stranded, linear
aaaaccguaaaggaaau

SEQ ID NO: 164 - DNA, 17 bp; single-stranded, linear
aaggaaaucacaggguu

SEQ ID NO: 165 - DNA, 17 bp; single-stranded, linear
cacaggguuuuugcuga

SEQ ID NO: 166 - DNA, 17 bp; single-stranded, linear
acaggguuuuugcugau

SEQ ID NO: 167 - DNA, 17 bp; single-stranded, linear
caggguuuuugcugauu

SEQ ID NO: 168 - DNA, 17 bp; single-stranded, linear
aggguuuuugcugauuc

SEQ ID NO: 169 - DNA, 17 bp; single-stranded, linear
uugcugauucaggcuug

SEQ ID NO: 170 - DNA, 17 bp; single-stranded, linear
ugcugauucaggcuugg

SEQ ID NO: 171 - DNA, 17 bp; single-stranded, linear
uucaggcuuggccugaa

SEQ ID NO: 172 - DNA, 17 bp; single-stranded, linear
acggaccuccaugccuu

SEQ ID NO: 173 - DNA, 17 bp; single-stranded, linear
ccaugccuuugagaacc

SEQ ID NO: 174 - DNA, 17 bp; single-stranded, linear
caugccuuugagaaccu

SEQ ID NO: 175 - DNA, 17 bp; single-stranded, linear
gagaaccuagaaaucau

SEQ ID NO: 176 - DNA, 17 bp; single-stranded, linear
cuagaaaucauacgcgg

SEQ ID NO: 177 - DNA, 17 bp; single-stranded, linear
gaaaucauacgcggcag

SEQ ID NO: 178 - DNA, 17 bp; single-stranded, linear
aacauggucaguuuucu

SEQ ID NO: 179 - DNA, 17 bp; single-stranded, linear
uggucaguuuucucuug

SEQ ID NO: 180 - DNA, 17 bp; single-stranded, linear
ggucaguuuucucuugc

SEQ ID NO: 181 - DNA, 17 bp; single-stranded, linear
gucaguuuucucuugca

SEQ ID NO: 182 - DNA, 17 bp; single-stranded, linear
ucaguuuucucuugcag

SEQ ID NO: 183 - DNA, 17 bp; single-stranded, linear
aguuuucucuugcaguc

SEQ ID NO: 184 - DNA, 17 bp; single-stranded, linear
uuuucucuugcagucgu

SEQ ID NO: 185 - DNA, 17 bp; single-stranded, linear
cuugcagucgucagccu

SEQ ID NO: 186 - DNA, 17 bp; single-stranded, linear
gcagucgucagccugaa

SEQ ID NO: 187 - DNA, 17 bp; single-stranded, linear
cugaacauaacauccuu

SEQ ID NO: 188 - DNA, 17 bp; single-stranded, linear
cauaacauccuugggau

SEQ ID NO: 189 - DNA, 17 bp; single-stranded, linear
aacauccuugggauuac

SEQ ID NO: 190 - DNA, 17 bp; single-stranded, linear
cuugggauuacgcuccc

SEQ ID NO: 191 - DNA, 17 bp; single-stranded, linear
uugggauuacgcucccu

SEQ ID NO: 192 - DNA, 17 bp; single-stranded, linear
auuacgcucccucaagg

SEQ ID NO: 193 - DNA, 17 bp; single-stranded, linear
cgcucccucaaggagau

SEQ ID NO: 194 - DNA, 17 bp; single-stranded, linear
aaggagauaagugaugg

SEQ ID NO: 195 - DNA, 17 bp; single-stranded, linear
gaugugauaauuucagg

SEQ ID NO: 196 - DNA, 17 bp; single-stranded, linear
gugauaauuucaggaaa

SEQ ID NO: 197 - DNA, 17 bp; single-stranded, linear
ugauaauuucaggaaac

SEQ ID NO: 198 - DNA, 17 bp; single-stranded, linear
gauaauuucaggaaaca

SEQ ID NO: 199 - DNA, 17 bp; single-stranded, linear
acaaaaauuugugcuau

SEQ ID NO: 200 - DNA, 17 bp; single-stranded, linear
caaaaauuugugcuaug

SEQ ID NO: 201 - DNA, 17 bp; single-stranded, linear
uuugugcuaugcaaaua

SEQ ID NO: 202 - DNA, 17 bp; single-stranded, linear
augcaaauacaauaaac

SEQ ID NO: 203 - DNA, 17 bp; single-stranded, linear
aauacaauaaacuggaa

SEQ ID NO: 204 - DNA, 17 bp; single-stranded, linear
aaaacuguuugggaccu

SEQ ID NO: 205 - DNA, 17 bp; single-stranded, linear
aaacuguuugggaccuc

SEQ ID NO: 206 - DNA, 17 bp; single-stranded, linear
ugggaccuccggucaga

SEQ ID NO: 207 - DNA, 17 bp; single-stranded, linear
ccuccggucagaaaacc

SEQ ID NO: 208 - DNA, 17 bp; single-stranded, linear
accaaaauuauaagcaa

SEQ ID NO: 209 - DNA, 17 bp; single-stranded, linear
ccaaaauuauaagcaac

SEQ ID NO: 210 - DNA, 17 bp; single-stranded, linear
aaaauuauaagcaacag

SEQ ID NO: 211 - DNA, 17 bp; single-stranded, linear
ggccaggucugccaugc

SEQ ID NO: 212 - DNA, 17 bp; single-stranded, linear
ccaugccuugugcuccc

SEQ ID NO: 213 - DNA, 17 bp; single-stranded, linear
cuugugcucccccgagg

SEQ ID NO: 214 - DNA, 17 bp; single-stranded, linear
gacugcgucucuugccg

SEQ ID NO: 215 - DNA, 17 bp; single-stranded, linear
cugcgucucuugccgga

SEQ ID NO: 216 - DNA, 17 bp; single-stranded, linear
gcgucucuugccggaau

SEQ ID NO: 217 - DNA, 17 bp; single-stranded, linear
cggaaugucagccgagg

SEQ ID NO: 218 - DNA, 17 bp; single-stranded, linear
ugcaagcuucuggaggg

SEQ ID NO: 219 - DNA, 17 bp; single-stranded, linear
gcaagcuucuggagggu

SEQ ID NO: 220 - DNA, 17 bp; single-stranded, linear
aagggaguuuguggaga

SEQ ID NO: 221 - DNA, 17 bp; single-stranded, linear
agggaguuuguggagaa

SEQ ID NO: 222 - DNA, 17 bp; single-stranded, linear
ggagaacucugagugca

SEQ ID NO: 223 - DNA, 17 bp; single-stranded, linear
gagugcauacagugcca

SEQ ID NO: 224 - DNA, 17 bp; single-stranded, linear
gccugccucaggccaug

SEQ ID NO: 225 - DNA, 17 bp; single-stranded, linear
augaacaucaccugcac

SEQ ID NO: 226 - DNA, 17 bp; single-stranded, linear
acaacuguauccagugu

SEQ ID NO: 227 - DNA, 17 bp; single-stranded, linear
aacuguauccagugugc

SEQ ID NO: 228 - DNA, 17 bp; single-stranded, linear
ugcccacuacauugacg

SEQ ID NO: 229 - DNA, 17 bp; single-stranded, linear
cacuacauugacggccc

SEQ ID NO: 230 - DNA, 17 bp; single-stranded, linear
cacugcgucaagaccug

SEQ ID NO: 231 - DNA, 17 bp; single-stranded, linear
gcaggagucaugggaga

SEQ ID NO: 232 - DNA, 17 bp; single-stranded, linear
acccuggucuggaagua

SEQ ID NO: 233 - DNA, 17 bp; single-stranded, linear
cuggaaguacgcagacg

SEQ ID NO: 234 - DNA, 17 bp; single-stranded, linear
ugugccauccaaacugc

SEQ ID NO: 235 - DNA, 17 bp; single-stranded, linear
cugcaccuacggaugca

SEQ ID NO: 236 - DNA, 17 bp; single-stranded, linear
ggccaggucuugaaggc

SEQ ID NO: 237 - DNA, 17 bp; single-stranded, linear
ccaggucuugaaggcug

SEQ ID NO: 238 - DNA, 17 bp; single-stranded, linear
aaggcuguccaacgaau

SEQ ID NO: 239 - DNA, 17 bp; single-stranded, linear
augggccuaagaucccg

SEQ ID NO: 240 - DNA, 17 bp; single-stranded, linear
ccuaagaucccguccau

SEQ ID NO: 241 - DNA, 17 bp; single-stranded, linear
gaucccguccaucgcca

SEQ ID NO: 242 - DNA, 17 bp; single-stranded, linear
ccguccaucgccacugg

SEQ ID NO: 243 - DNA, 17 bp; single-stranded, linear
ggggcccuccucuugcu

SEQ ID NO: 244 - DNA, 17 bp; single-stranded, linear
gcccuccucuugcugcu

SEQ ID NO: 245 - DNA, 17 bp; single-stranded, linear
ccuccucuugcugcugg

SEQ ID NO: 246 - DNA, 17 bp; single-stranded, linear
cuggggaucggccucuu

SEQ ID NO: 247 - DNA, 17 bp; single-stranded, linear
aucggccucuucaugcg

SEQ ID NO: 248 - DNA, 17 bp; single-stranded, linear
cggccucuucaugcgaa

SEQ ID NO: 249 - DNA, 17 bp; single-stranded, linear
ggccucuucaugcgaag

SEQ ID NO: 250 - DNA, 17 bp; single-stranded, linear
cgccacaucguucggaa

SEQ ID NO: 251 - DNA, 17 bp; single-stranded, linear
cacaucguucggaagcg

SEQ ID NO: 252 - DNA, 17 bp; single-stranded, linear
acaucguucggaagcgc

SEQ ID NO: 253 - DNA, 17 bp; single-stranded, linear
agggagcuuguggagcc

SEQ ID NO: 254 - DNA, 17 bp; single-stranded, linear
uggagccucuuacaccc

SEQ ID NO: 255 - DNA, 17 bp; single-stranded, linear
gagccucuuacacccag

SEQ ID NO: 256 - DNA, 17 bp; single-stranded, linear
agccucuuacacccagu

SEQ ID NO: 257 - DNA, 17 bp; single-stranded, linear
gagaagcucccaaccaa

SEQ ID NO: 258 - DNA, 17 bp; single-stranded, linear
accaagcucucuugagg

SEQ ID NO: 259 - DNA, 17 bp; single-stranded, linear
caagcucucuugaggau

SEQ ID NO: 260 - DNA, 17 bp; single-stranded, linear
agcucucuugaggaucu

SEQ ID NO: 261 - DNA, 17 bp; single-stranded, linear
uugaggaucuugaagga

SEQ ID NO: 262 - DNA, 17 bp; single-stranded, linear
gaggaucuugaaggaaa

SEQ ID NO: 263 - DNA, 17 bp; single-stranded, linear
aacugaauucaaaaaga

SEQ ID NO: 264 - DNA, 17 bp; single-stranded, linear
acugaauucaaaaagau

SEQ ID NO: 265 - DNA, 17 bp; single-stranded, linear
aaaaagaucaaagugcu

SEQ ID NO: 266 - DNA, 17 bp; single-stranded, linear
gcugggcuccggugcgu

SEQ ID NO: 267 - DNA, 17 bp; single-stranded, linear
cggugcguucggcacgg

SEQ ID NO: 268 - DNA, 17 bp; single-stranded, linear
ggugcguucggcacggu

SEQ ID NO: 269 - DNA, 17 bp; single-stranded, linear
cacgguguauaagggac

SEQ ID NO: 270 - DNA, 17 bp; single-stranded, linear
cgguguauaagggacuc

SEQ ID NO: 271 - DNA, 17 bp; single-stranded, linear
aagggacucuggauccc

SEQ ID NO: 272 - DNA, 17 bp; single-stranded, linear
cucuggaucccagaagg

SEQ ID NO: 273 - DNA, 17 bp; single-stranded, linear
gagaaaguuaaaauucc

SEQ ID NO: 274 - DNA, 17 bp; single-stranded, linear
agaaaguuaaaauuccc

SEQ ID NO: 275 - DNA, 17 bp; single-stranded, linear
guuaaaauucccgucgc

SEQ ID NO: 276 - DNA, 17 bp; single-stranded, linear
uuaaaauucccgucgcu

SEQ ID NO: 277 - DNA, 17 bp; single-stranded, linear
auucccgucgcuaucaa

SEQ ID NO: 278 - DNA, 17 bp; single-stranded, linear
ccgucgcuaucaaggaa

SEQ ID NO: 279 - DNA, 17 bp; single-stranded, linear
gucgcuaucaaggaauu

SEQ ID NO: 280 - DNA, 17 bp; single-stranded, linear
caaggaauuaagagaag

SEQ ID NO: 281 - DNA, 17 bp; single-stranded, linear
aaggaauuaagagaagc

SEQ ID NO: 282 - DNA, 17 bp; single-stranded, linear
agcaacaucuccgaaag

SEQ ID NO: 283 - DNA, 17 bp; single-stranded, linear
caacaucuccgaaagcc

SEQ ID NO: 284 - DNA, 17 bp; single-stranded, linear
aaggaaauccucgauga

SEQ ID NO: 285 - DNA, 17 bp; single-stranded, linear
gaaauccucgaugaagc

SEQ ID NO: 286 - DNA, 17 bp; single-stranded, linear
ugaagccuacgugaugg

SEQ ID NO: 287 - DNA, 17 bp; single-stranded, linear
cugggcaucugccucac

SEQ ID NO: 288 - DNA, 17 bp; single-stranded, linear
aucugccucaccuccac

SEQ ID NO: 289 - DNA, 17 bp; single-stranded, linear
ccucaccuccaccgugc

SEQ ID NO: 290 - DNA, 17 bp; single-stranded, linear
gugcaacucaucacgca

SEQ ID NO: 291 - DNA, 17 bp; single-stranded, linear
caacucaucacgcagcu

SEQ ID NO: 292 - DNA, 17 bp; single-stranded, linear
acgcagcucaugcccuu

SEQ ID NO: 293 - DNA, 17 bp; single-stranded, linear
caugcccuucggcugcc

SEQ ID NO: 294 - DNA, 17 bp; single-stranded, linear
augcccuucggcugccu

SEQ ID NO: 295 - DNA, 17 bp; single-stranded, linear
ggcugccuccuggacua

SEQ ID NO: 296 - DNA, 17 bp; single-stranded, linear
ccuggacuauguccggg

SEQ ID NO: 297 - DNA, 17 bp; single-stranded, linear
gacuauguccgggaaca

SEQ ID NO: 298 - DNA, 17 bp; single-stranded, linear
aagacaauauuggcucc

SEQ ID NO: 299 - DNA, 17 bp; single-stranded, linear
gacaauauuggcuccca

SEQ ID NO: 300 - DNA, 17 bp; single-stranded, linear
uauuggcucccaguacc

SEQ ID NO: 301 - DNA, 17 bp; single-stranded, linear
cucccaguaccugcuca

SEQ ID NO: 302 - DNA, 17 bp; single-stranded, linear
uaccugcucaacuggug

SEQ ID NO: 303 - DNA, 17 bp; single-stranded, linear
gugcagaucgcaaaggg

SEQ ID NO: 304 - DNA, 17 bp; single-stranded, linear
caugaacuacuuggagg

SEQ ID NO: 305 - DNA, 17 bp; single-stranded, linear
gaacuacuuggaggacc

SEQ ID NO: 306 - DNA, 17 bp; single-stranded, linear
aggaccgucgcuuggug

SEQ ID NO: 307 - DNA, 17 bp; single-stranded, linear
ccgucgcuuggugcacc

SEQ ID NO: 308 - DNA, 17 bp; single-stranded, linear
aggaacguacuggugaa

SEQ ID NO: 309 - DNA, 17 bp; single-stranded, linear
cagcaugucaagaucac

SEQ ID NO: 310 - DNA, 17 bp; single-stranded, linear
gucaagaucacagauuu

SEQ ID NO: 311 - DNA, 17 bp; single-stranded, linear
ucacagauuuugggcug

SEQ ID NO: 312 - DNA, 17 bp; single-stranded, linear
cacagauuuugggcugg

SEQ ID NO: 313 - DNA, 17 bp; single-stranded, linear
acagauuuugggcuggc

SEQ ID NO: 314 - DNA, 17 bp; single-stranded, linear
gaaagaauaccaugcag

SEQ ID NO: 315 - DNA, 17 bp; single-stranded, linear
aagugccuaucaagugg

SEQ ID NO: 316 - DNA, 17 bp; single-stranded, linear
gugccuaucaaguggau

SEQ ID NO: 317 - DNA, 17 bp; single-stranded, linear
gauggcauuggaaucaa

SEQ ID NO: 318 - DNA, 17 bp; single-stranded, linear
auuggaaucaauuuuac

SEQ ID NO: 319 - DNA, 17 bp; single-stranded, linear
gaaucaauuuuacacag

SEQ ID NO: 320 - DNA, 17 bp; single-stranded, linear
aaucaauuuuacacaga

SEQ ID NO: 321 - DNA, 17 bp; single-stranded, linear
aucaauuuuacacagaa

SEQ ID NO: 322 - DNA, 17 bp; single-stranded, linear
ucaauuuuacacagaau

SEQ ID NO: 323 - DNA, 17 bp; single-stranded, linear
cacagaaucuauaccca

SEQ ID NO: 324 - DNA, 17 bp; single-stranded, linear
cagaaucuauacccacc

SEQ ID NO: 325 - DNA, 17 bp; single-stranded, linear
gaaucuauacccaccag

SEQ ID NO: 326 - DNA, 17 bp; single-stranded, linear
agugaugucuggagcua

SEQ ID NO: 327 - DNA, 17 bp; single-stranded, linear
cuggagcuacgggguga

SEQ ID NO: 328 - DNA, 17 bp; single-stranded, linear
gugaccguuugggaguu

SEQ ID NO: 329 - DNA, 17 bp; single-stranded, linear
ugaccguuugggaguug

SEQ ID NO: 330 - DNA, 17 bp; single-stranded, linear
uugggaguugaugaccu

SEQ ID NO: 331 - DNA, 17 bp; single-stranded, linear
gaugaccuuuggaucca

SEQ ID NO: 332 - DNA, 17 bp; single-stranded, linear
augaccuuuggauccaa

SEQ ID NO: 333 - DNA, 17 bp; single-stranded, linear
cuuuggauccaagccau

SEQ ID NO: 334 - DNA, 17 bp; single-stranded, linear
caagccauaugacggaa

SEQ ID NO: 335 - DNA, 17 bp; single-stranded, linear
gacggaaucccugccag

SEQ ID NO: 336 - DNA, 17 bp; single-stranded, linear
agcgagaucuccuccau

SEQ ID NO: 337 - DNA, 17 bp; single-stranded, linear
cgagaucuccuccaucc

SEQ ID NO: 338 - DNA, 17 bp; single-stranded, linear
gaucuccuccauccugg

SEQ ID NO: 339 - DNA, 17 bp; single-stranded, linear
uccuccauccuggagaa

SEQ ID NO: 340 - DNA, 17 bp; single-stranded, linear
gaacgccucccucagcc

SEQ ID NO: 341 - DNA, 17 bp; single-stranded, linear
gccucccucagccaccc

SEQ ID NO: 342 - DNA, 17 bp; single-stranded, linear
ccacccauauguaccau

SEQ ID NO: 343 - DNA, 17 bp; single-stranded, linear
ccauauguaccaucgau

SEQ ID NO: 344 - DNA, 17 bp; single-stranded, linear
uguaccaucgaugucua

SEQ ID NO: 345 - DNA, 17 bp; single-stranded, linear
aucgaugucuacaugau

SEQ ID NO: 346 - DNA, 17 bp; single-stranded, linear
cgaugucuacaugauca

SEQ ID NO: 347 - DNA, 17 bp; single-stranded, linear
uacaugaucauggucaa

SEQ ID NO: 348 - DNA, 17 bp; single-stranded, linear
aucauggucaagugcug

SEQ ID NO: 349 - DNA, 17 bp; single-stranded, linear
uggaugauagacgcaga

SEQ ID NO: 350 - DNA, 17 bp; single-stranded, linear
acgcagauagucgccca

SEQ ID NO: 351 - DNA, 17 bp; single-stranded, linear
cagauagucgcccaaag

SEQ ID NO: 352 - DNA, 17 bp; single-stranded, linear
cccaaaguuccgugagu

SEQ ID NO: 353 - DNA, 17 bp; single-stranded, linear
ccaaaguuccgugaguu

SEQ ID NO: 354 - DNA, 17 bp; single-stranded, linear
ccgugaguugaucaucg

SEQ ID NO: 355 - DNA, 17 bp; single-stranded, linear
gaguugaucaucgaauu

SEQ ID NO: 356 - DNA, 17 bp; single-stranded, linear
uugaucaucgaauucuc

SEQ ID NO: 357 - DNA, 17 bp; single-stranded, linear
caucgaauucuccaaaa

SEQ ID NO: 358 - DNA, 17 bp; single-stranded, linear
aucgaauucuccaaaau

SEQ ID NO: 359 - DNA, 17 bp; single-stranded, linear
cgaauucuccaaaaugg

SEQ ID NO: 360 - DNA, 17 bp; single-stranded, linear
ccagcgcuaccuuguca

SEQ ID NO: 361 - DNA, 17 bp; single-stranded, linear
cgcuaccuugucauuca

SEQ ID NO: 362 - DNA, 17 bp; single-stranded, linear
uaccuugucauucaggg

SEQ ID NO: 363 - DNA, 17 bp; single-stranded, linear
cuugucauucaggggga

SEQ ID NO: 364 - DNA, 17 bp; single-stranded, linear
uugucauucagggggau

SEQ ID NO: 365 - DNA, 17 bp; single-stranded, linear
gaaugcauuugccaagu

SEQ ID NO: 366 - DNA, 17 bp; single-stranded, linear
aaugcauuugccaaguc

SEQ ID NO: 367 - DNA, 17 bp; single-stranded, linear
ugccaaguccuacagac

SEQ ID NO: 368 - DNA, 17 bp; single-stranded, linear
caaguccuacagacucc

SEQ ID NO: 369 - DNA, 17 bp; single-stranded, linear
uacagacuccaacuucu

SEQ ID NO: 370 - DNA, 17 bp; single-stranded, linear
cuccaacuucuaccgug

SEQ ID NO: 371 - DNA, 17 bp; single-stranded, linear
uccaacuucuaccgugc

SEQ ID NO: 372 - DNA, 17 bp; single-stranded, linear
caacuucuaccgugccc

SEQ ID NO: 373 - DNA, 17 bp; single-stranded, linear
cgacgaguaccucaucc

SEQ ID NO: 374 - DNA, 17 bp; single-stranded, linear
gaguaccucaucccaca

SEQ ID NO: 375 - DNA, 17 bp; single-stranded, linear
uaccucaucccacagca

SEQ ID NO: 376 - DNA, 17 bp; single-stranded, linear
gcagggcuucuucagca

SEQ ID NO: 377 - DNA, 17 bp; single-stranded, linear
cagggcuucuucagcag

SEQ ID NO: 378 - DNA, 17 bp; single-stranded, linear
gggcuucuucagcagcc

SEQ ID NO: 379 - DNA, 17 bp; single-stranded, linear
ggcuucuucagcagccc

SEQ ID NO: 380 - DNA, 17 bp; single-stranded, linear
cagccccuccacgucac

SEQ ID NO: 381 - DNA, 17 bp; single-stranded, linear
cuccacgucacggacuc

SEQ ID NO: 382 - DNA, 17 bp; single-stranded, linear
cacggacuccccuccug

SEQ ID NO: 383 - DNA, 17 bp; single-stranded, linear
acuccccuccugagcuc

SEQ ID NO: 384 - DNA, 17 bp; single-stranded, linear
ccugagcucucugagug

SEQ ID NO: 385 - DNA, 17 bp; single-stranded, linear
ugagcucucugagugca

SEQ ID NO: 386 - DNA, 17 bp; single-stranded, linear
gcaacaauuccaccgug

SEQ ID NO: 387 - DNA, 17 bp; single-stranded, linear
caacaauuccaccgugg

SEQ ID NO: 388 - DNA, 17 bp; single-stranded, linear
ccguggcuugcauugau

SEQ ID NO: 389 - DNA, 17 bp; single-stranded, linear
gcuugcauugauagaaa

SEQ ID NO: 390 - DNA, 17 bp; single-stranded, linear
gcauugauagaaauggg

SEQ ID NO: 391 - DNA, 17 bp; single-stranded, linear
aaagcugucccaucaag

SEQ ID NO: 392 - DNA, 17 bp; single-stranded, linear
ugucccaucaaggaaga

SEQ ID NO: 393 - DNA, 17 bp; single-stranded, linear
agacagcuucuugcagc

SEQ ID NO: 394 - DNA, 17 bp; single-stranded, linear
gacagcuucuugcagcg

SEQ ID NO: 395 - DNA, 17 bp; single-stranded, linear
cagcuucuugcagcgau

SEQ ID NO: 396 - DNA, 17 bp; single-stranded, linear
gcagcgauacagcucag

SEQ ID NO: 397 - DNA, 17 bp; single-stranded, linear
auacagcucagacccca

SEQ ID NO: 398 - DNA, 17 bp; single-stranded, linear
aggcgccuugacugagg

SEQ ID NO: 399 - DNA, 17 bp; single-stranded, linear
gacagcauagacgacac

SEQ ID NO: 400 - DNA, 17 bp; single-stranded, linear
cgacaccuuccucccag

SEQ ID NO: 401 - DNA, 17 bp; single-stranded, linear
gacaccuuccucccagu

SEQ ID NO: 402 - DNA, 17 bp; single-stranded, linear
accuuccucccagugcc

SEQ ID NO: 403 - DNA, 17 bp; single-stranded, linear
gccugaauacauaaacc

SEQ ID NO: 404 - DNA, 17 bp; single-stranded, linear
gaauacauaaaccaguc

SEQ ID NO: 405 - DNA, 17 bp; single-stranded, linear
aaaccaguccguuccca

SEQ ID NO: 406 - DNA, 17 bp; single-stranded, linear
caguccguucccaaaag

SEQ ID NO: 407 - DNA, 17 bp; single-stranded, linear
aguccguucccaaaagg

SEQ ID NO: 408 - DNA, 17 bp; single-stranded, linear
cgcuggcucugugcaga

SEQ ID NO: 409 - DNA, 17 bp; single-stranded, linear
ugcagaauccugucuau

SEQ ID NO: 410 - DNA, 17 bp; single-stranded, linear
aauccugucuaucacaa

SEQ ID NO: 411 - DNA, 17 bp; single-stranded, linear
uccugucuaucacaauc

SEQ ID NO: 412 - DNA, 17 bp; single-stranded, linear
cugucuaucacaaucag

SEQ ID NO: 413 - DNA, 17 bp; single-stranded, linear
aucacaaucagccucug

SEQ ID NO: 414 - DNA, 17 bp; single-stranded, linear
aucagccucugaacccc

SEQ ID NO: 415 - DNA, 17 bp; single-stranded, linear
cccacacuaccaggacc

SEQ ID NO: 416 - DNA, 17 bp; single-stranded, linear
ccccgaguaucucaaca

SEQ ID NO: 417 - DNA, 17 bp; single-stranded, linear
ccgaguaucucaacacu

SEQ ID NO: 418 - DNA, 17 bp; single-stranded, linear
gaguaucucaacacugu

SEQ ID NO: 419 - DNA, 17 bp; single-stranded, linear
aacacuguccagcccac

SEQ ID NO: 420 - DNA, 17 bp; single-stranded, linear
accugugucaacagcac

SEQ ID NO: 421 - DNA, 17 bp; single-stranded, linear
cagcacauucgacagcc

SEQ ID NO: 422 - DNA, 17 bp; single-stranded, linear
agcacauucgacagccc

SEQ ID NO: 423 - DNA, 17 bp; single-stranded, linear
caccaaauuagccugga

SEQ ID NO: 424 - DNA, 17 bp; single-stranded, linear
accaaauuagccuggac

SEQ ID NO: 425 - DNA, 17 bp; single-stranded, linear
cccugacuaccagcagg

SEQ ID NO: 426 - DNA, 17 bp; single-stranded, linear
gcaggacuucuuuccca

SEQ ID NO: 427 - DNA, 17 bp; single-stranded, linear
caggacuucuuucccaa

SEQ ID NO: 428 - DNA, 17 bp; single-stranded, linear
ggacuucuuucccaagg

SEQ ID NO: 429 - DNA, 17 bp; single-stranded, linear
gacuucuuucccaagga

SEQ ID NO: 430 - DNA, 17 bp; single-stranded, linear
acuucuuucccaaggaa

SEQ ID NO: 431 - DNA, 17 bp; single-stranded, linear
aauggcaucuuuaaggg

SEQ ID NO: 432 - DNA, 17 bp; single-stranded, linear
uggcaucuuuaagggcu

SEQ ID NO: 433 - DNA, 17 bp; single-stranded, linear
ggcaucuuuaagggcuc

SEQ ID NO: 434 - DNA, 17 bp; single-stranded, linear
gcaucuuuaagggcucc

SEQ ID NO: 435 - DNA, 17 bp; single-stranded, linear
uaagggcuccacagcug

SEQ ID NO: 436 - DNA, 17 bp; single-stranded, linear
ugcagaauaccuaaggg

SEQ ID NO: 437 - DNA, 17 bp; single-stranded, linear
gaauaccuaagggucgc

SEQ ID NO: 438 - DNA, 17 bp; single-stranded, linear
cuaagggucgcgccaca

SEQ ID NO: 439 - DNA, 17 bp; single-stranded, linear
cagugaauuuauuggag

SEQ ID NO: 440 - DNA, 17 bp; single-stranded, linear
agugaauuuauuggagc

SEQ ID NO: 441 - DNA, 17 bp; single-stranded, linear
gugaauuuauuggagca

SEQ ID NO: 442 - DNA, 17 bp; single-stranded, linear
gaauuuauuggagcaug

SEQ ID NO: 443 - DNA, 17 bp; single-stranded, linear
cggaggauaguaugagc

SEQ ID NO: 444 - DNA, 17 bp; single-stranded, linear
aggauaguaugagcccu

SEQ ID NO: 445 - DNA, 17 bp; single-stranded, linear
ugagcccuaaaaaucca

SEQ ID NO: 446 - DNA, 17 bp; single-stranded, linear
cuaaaaauccagacucu

SEQ ID NO: 447 - DNA, 17 bp; single-stranded, linear
uccagacucuuucgaua

SEQ ID NO: 448 - DNA, 17 bp; single-stranded, linear
cagacucuuucgauacc

SEQ ID NO: 449 - DNA, 17 bp; single-stranded, linear
agacucuuucgauaccc

SEQ ID NO: 450 - DNA, 17 bp; single-stranded, linear
gacucuuucgauaccca

SEQ ID NO: 451 - DNA, 17 bp; single-stranded, linear
cuuucgauacccaggac

SEQ ID NO: 452 - DNA, 17 bp; single-stranded, linear
cagcagguccuccaucc

SEQ ID NO: 453 - DNA, 17 bp; single-stranded, linear
cagguccuccaucccaa

SEQ ID NO: 454 - DNA, 17 bp; single-stranded, linear
uccuccaucccaacagc

SEQ ID NO: 455 - DNA, 17 bp; single-stranded, linear
gcccgcauuagcucuua

SEQ ID NO: 456 - DNA, 17 bp; single-stranded, linear
cccgcauuagcucuuag

SEQ ID NO: 457 - DNA, 17 bp; single-stranded, linear
cauuagcucuuagaccc

SEQ ID NO: 458 - DNA, 17 bp; single-stranded, linear
uuagcucuuagacccac

SEQ ID NO: 459 - DNA, 17 bp; single-stranded, linear
uagcucuuagacccaca

SEQ ID NO: 460 - DNA, 17 bp; single-stranded, linear
agacugguuuugcaacg

SEQ ID NO: 461 - DNA, 17 bp; single-stranded, linear
gacugguuuugcaacgu

SEQ ID NO: 462 - DNA, 17 bp; single-stranded, linear
acugguuuugcaacguu

SEQ ID NO: 463 - DNA, 17 bp; single-stranded, linear
ugcaacguuuacaccga

SEQ ID NO: 464 - DNA, 17 bp; single-stranded, linear
gcaacguuuacaccgac

SEQ ID NO: 465 - DNA, 17 bp; single-stranded, linear
caacguuuacaccgacu

SEQ ID NO: 466 - DNA, 17 bp; single-stranded, linear
caccgacuagccaggaa

SEQ ID NO: 467 - DNA, 17 bp; single-stranded, linear
caggaaguacuuccacc

SEQ ID NO: 468 - DNA, 17 bp; single-stranded, linear
gaaguacuuccaccucg

SEQ ID NO: 469 - DNA, 17 bp; single-stranded, linear
aaguacuuccaccucgg

SEQ ID NO: 470 - DNA, 17 bp; single-stranded, linear
uuccaccucgggcacau

SEQ ID NO: 471 - DNA, 17 bp; single-stranded, linear
gggcacauuuugggaag

SEQ ID NO: 472 - DNA, 17 bp; single-stranded, linear
ggcacauuuugggaagu

SEQ ID NO: 473 - DNA, 17 bp; single-stranded, linear
gcacauuuugggaaguu

SEQ ID NO: 474 - DNA, 17 bp; single-stranded, linear
ugggaaguugcauuccu

SEQ ID NO: 475 - DNA, 17 bp; single-stranded, linear
aguugcauuccuuuguc

SEQ ID NO: 476 - DNA, 17 bp; single-stranded, linear
guugcauuccuuugucu

SEQ ID NO: 477 - DNA, 17 bp; single-stranded, linear
gcauuccuuugucuuca

SEQ ID NO: 478 - DNA, 17 bp; single-stranded, linear
cauuccuuugucuucaa

SEQ ID NO: 479 - DNA, 17 bp; single-stranded, linear
uccuuugucuucaaacu

SEQ ID NO: 480 - DNA, 17 bp; single-stranded, linear
cuuugucuucaaacugu

SEQ ID NO: 481 - DNA, 17 bp; single-stranded, linear
uuugucuucaaacugug

SEQ ID NO: 482 - DNA, 17 bp; single-stranded, linear
ugaagcauuuacagaaa

SEQ ID NO: 483 - DNA, 17 bp; single-stranded, linear
gaagcauuuacagaaac

SEQ ID NO: 484 - DNA, 17 bp; single-stranded, linear
aagcauuuacagaaacg

SEQ ID NO: 485 - DNA, 17 bp; single-stranded, linear
aaacgcauccagcaaga

SEQ ID NO: 486 - DNA, 17 bp; single-stranded, linear
gcaagaauauugucccu

SEQ ID NO: 487 - DNA, 17 bp; single-stranded, linear
aagaauauugucccuuu

SEQ ID NO: 488 - DNA, 17 bp; single-stranded, linear
aauauugucccuuugag

SEQ ID NO: 489 - DNA, 17 bp; single-stranded, linear
uugucccuuugagcaga

SEQ ID NO: 490 - DNA, 17 bp; single-stranded, linear
ugucccuuugagcagaa

SEQ ID NO: 491 - DNA, 17 bp; single-stranded, linear
gcagaaauuuaucuuuc

SEQ ID NO: 492 - DNA, 17 bp; single-stranded, linear
cagaaauuuaucuuuca

SEQ ID NO: 493 - DNA, 17 bp; single-stranded, linear
agaaauuuaucuuucaa

SEQ ID NO: 494 - DNA, 17 bp; single-stranded, linear
aaauuuaucuuucaaag

SEQ ID NO: 495 - DNA, 17 bp; single-stranded, linear
auuuaucuuucaaagag

SEQ ID NO: 496 - DNA, 17 bp; single-stranded, linear
uuuaucuuucaaagagg

SEQ ID NO: 497 - DNA, 17 bp; single-stranded, linear
uuaucuuucaaagaggu

SEQ ID NO: 498 - DNA, 17 bp; single-stranded, linear
aaagagguauauuugaa

SEQ ID NO: 499 - DNA, 17 bp; single-stranded, linear
agagguauauuugaaaa

SEQ ID NO: 500 - DNA, 17 bp; single-stranded, linear
agguauauuugaaaaaa

SEQ ID NO: 501 - DNA, 17 bp; single-stranded, linear
gguauauuugaaaaaaa

SEQ ID NO: 502 - DNA, 17 bp; single-stranded, linear
aaaaaaguauaugugag

SEQ ID NO: 503 - DNA, 17 bp; single-stranded, linear
aaaaguauaugugagga

SEQ ID NO: 504 - DNA, 17 bp; single-stranded, linear
gugaggauuuuuauuga

SEQ ID NO: 505 - DNA, 17 bp; single-stranded, linear
ugaggauuuuuauugau

SEQ ID NO: 506 - DNA, 17 bp; single-stranded, linear
gaggauuuuuauugauu

SEQ ID NO: 507 - DNA, 17 bp; single-stranded, linear
aggauuuuuauugauug

SEQ ID NO: 508 - DNA, 17 bp; single-stranded, linear
ggauuuuuauugauugg

SEQ ID NO: 509 - DNA, 17 bp; single-stranded, linear
auuuuuauugauugggg

SEQ ID NO: 510 - DNA, 17 bp; single-stranded, linear
uuauugauuggggaucu

SEQ ID NO: 511 - DNA, 17 bp; single-stranded, linear
uuggggaucuuggaguu

SEQ ID NO: 512 - DNA, 17 bp; single-stranded, linear
ggggaucuuggaguuuu

SEQ ID NO: 513 - DNA, 17 bp; single-stranded, linear
cuuggaguuuuucauug

SEQ ID NO: 514 - DNA, 17 bp; single-stranded, linear
uuggaguuuuucauugu

SEQ ID NO: 515 - DNA, 17 bp; single-stranded, linear
uggaguuuuucauuguc

SEQ ID NO: 516 - DNA, 17 bp; single-stranded, linear
ggaguuuuucauugucg

SEQ ID NO: 517 - DNA, 17 bp; single-stranded, linear
gaguuuuucauugucgc

SEQ ID NO: 518 - DNA, 17 bp; single-stranded, linear
uuuuucauugucgcuau

SEQ ID NO: 519 - DNA, 17 bp; single-stranded, linear
uucauugucgcuauuga

SEQ ID NO: 520 - DNA, 17 bp; single-stranded, linear
uugucgcuauugauuuu

SEQ ID NO: 521 - DNA, 17 bp; single-stranded, linear
gucgcuauugauuuuua

SEQ ID NO: 522 - DNA, 17 bp; single-stranded, linear
cuauugauuuuuacuuc

SEQ ID NO: 523 - DNA, 17 bp; single-stranded, linear
uauugauuuuuacuuca

SEQ ID NO: 524 - DNA, 17 bp; single-stranded, linear
auugauuuuuacuucaa

SEQ ID NO: 525 - DNA, 17 bp; single-stranded, linear
uugauuuuuacuucaau

SEQ ID NO: 526 - DNA, 17 bp; single-stranded, linear
ugauuuuuacuucaaug

SEQ ID NO: 527 - DNA, 17 bp; single-stranded, linear
uuuuuacuucaaugggc

SEQ ID NO: 528 - DNA, 17 bp; single-stranded, linear
uuuuacuucaaugggcu

SEQ ID NO: 529 - DNA, 17 bp; single-stranded, linear
aaugggcucuuccaaca

SEQ ID NO: 530 - DNA, 17 bp; single-stranded, linear
ugggcucuuccaacaag

SEQ ID NO: 531 - DNA, 17 bp; single-stranded, linear
gggcucuuccaacaagg

SEQ ID NO: 532 - DNA, 17 bp; single-stranded, linear
aagaagcuugcugguag

SEQ ID NO: 533 - DNA, 17 bp; single-stranded, linear
uugcugguagcacuugc

SEQ ID NO: 534 - DNA, 17 bp; single-stranded, linear
guagcacuugcuacccu

SEQ ID NO: 535 - DNA, 17 bp; single-stranded, linear
cacuugcuacccugagu

SEQ ID NO: 536 - DNA, 17 bp; single-stranded, linear
cccugaguucauccagg

SEQ ID NO: 537 - DNA, 17 bp; single-stranded, linear
ccugaguucauccaggc

SEQ ID NO: 538 - DNA, 17 bp; single-stranded, linear
gaguucauccaggccca

SEQ ID NO: 539 - DNA, 17 bp; single-stranded, linear
ccacaagucuuccagag

SEQ ID NO: 540 - DNA, 17 bp; single-stranded, linear
acaagucuuccagagga

SEQ ID NO: 541 - DNA, 17 bp; single-stranded, linear
caagucuuccagaggau

SEQ ID NO: 542 - DNA, 17 bp; single-stranded, linear
aggaugcuugauuccag

SEQ ID NO: 543 - DNA, 17 bp; single-stranded, linear
ugcuugauuccaguggu

SEQ ID NO: 544 - DNA, 17 bp; single-stranded, linear
gcuugauuccagugguu

SEQ ID NO: 545 - DNA, 17 bp; single-stranded, linear
ccagugguucugcuuca

SEQ ID NO: 546 - DNA, 17 bp; single-stranded, linear
cagugguucugcuucaa

SEQ ID NO: 547 - DNA, 17 bp; single-stranded, linear
guucugcuucaaggcuu

SEQ ID NO: 548 - DNA, 17 bp; single-stranded, linear
uucugcuucaaggcuuc

SEQ ID NO: 549 - DNA, 17 bp; single-stranded, linear
ucaaggcuuccacugca

SEQ ID NO: 550 - DNA, 17 bp; single-stranded, linear
caaggcuuccacugcaa

SEQ ID NO: 551 - DNA, 17 bp; single-stranded, linear
aaaacacuaaagaucca

SEQ ID NO: 552 - DNA, 17 bp; single-stranded, linear
cuaaagauccaagaagg

SEQ ID NO: 553 - DNA, 17 bp; single-stranded, linear
gaaggccuucauggccc

SEQ ID NO: 554 - DNA, 17 bp; single-stranded, linear
aaggccuucauggcccc

SEQ ID NO: 555 - DNA, 17 bp; single-stranded, linear
ggccggaucgguacugu

SEQ ID NO: 556 - DNA, 17 bp; single-stranded, linear
ggaucgguacuguauca

SEQ ID NO: 557 - DNA, 17 bp; single-stranded, linear
gguacuguaucaaguca

SEQ ID NO: 558 - DNA, 17 bp; single-stranded, linear
uacuguaucaagucaug

SEQ ID NO: 559 - DNA, 17 bp; single-stranded, linear
uaucaagucauggcagg

SEQ ID NO: 560 - DNA, 17 bp; single-stranded, linear
uggcagguacaguagga

SEQ ID NO: 561 - DNA, 17 bp; single-stranded, linear
gguacaguaggauaagc

SEQ ID NO: 562 - DNA, 17 bp; single-stranded, linear
aguaggauaagccacuc

SEQ ID NO: 563 - DNA, 17 bp; single-stranded, linear
aagccacucugucccuu

SEQ ID NO: 564 - DNA, 17 bp; single-stranded, linear
cacucugucccuuccug

SEQ ID NO: 565 - DNA, 17 bp; single-stranded, linear
cugucccuuccugggca

SEQ ID NO: 566 - DNA, 17 bp; single-stranded, linear
ugucccuuccugggcaa

SEQ ID NO: 567 - DNA, 17 bp; single-stranded, linear
ggaugaauucuuccuua

SEQ ID NO: 568 - DNA, 17 bp; single-stranded, linear
gaugaauucuuccuuag

SEQ ID NO: 569 - DNA, 17 bp; single-stranded, linear
ugaauucuuccuuagac

SEQ ID NO: 570 - DNA, 17 bp; single-stranded, linear
gaauucuuccuuagacu

SEQ ID NO: 571 - DNA, 17 bp; single-stranded, linear
uucuuccuuagacuuac

SEQ ID NO: 572 - DNA, 17 bp; single-stranded, linear
ucuuccuuagacuuacu

SEQ ID NO: 573 - DNA, 17 bp; single-stranded, linear
cuuagacuuacuuuugu

SEQ ID NO: 574 - DNA, 17 bp; single-stranded, linear
uuagacuuacuuuugua

SEQ ID NO: 575 - DNA, 17 bp; single-stranded, linear
gacuuacuuuuguaaaa

SEQ ID NO: 576 - DNA, 17 bp; single-stranded, linear
acuuacuuuuguaaaaa

SEQ ID NO: 577 - DNA, 17 bp; single-stranded, linear
cuuacuuuuguaaaaau

SEQ ID NO: 578 - DNA, 17 bp; single-stranded, linear
acuuuuguaaaaauguc

SEQ ID NO: 579 - DNA, 17 bp; single-stranded, linear
aaaaauguccccacggu

SEQ ID NO: 580 - DNA, 17 bp; single-stranded, linear
cccacgguacuuacucc

SEQ ID NO: 581 - DNA, 17 bp; single-stranded, linear
acgguacuuacucccca

SEQ ID NO: 582 - DNA, 17 bp; single-stranded, linear
cgguacuuacuccccac

SEQ ID NO: 583 - DNA, 17 bp; single-stranded, linear
uacuuacuccccacuga

SEQ ID NO: 584 - DNA, 17 bp; single-stranded, linear
ccagugguuuccaguca

SEQ ID NO: 585 - DNA, 17 bp; single-stranded, linear
cagugguuuccagucau

SEQ ID NO: 586 - DNA, 17 bp; single-stranded, linear
agugguuuccagucaug

SEQ ID NO: 587 - DNA, 17 bp; single-stranded, linear
uuuccagucaugagcgu

SEQ ID NO: 588 - DNA, 17 bp; single-stranded, linear
augagcguuagacugac

SEQ ID NO: 589 - DNA, 17 bp; single-stranded, linear
ugagcguuagacugacu

SEQ ID NO: 590 - DNA, 17 bp; single-stranded, linear
gacugacuuguuugucu

SEQ ID NO: 591 - DNA, 17 bp; single-stranded, linear
ugacuuguuugucuucc

SEQ ID NO: 592 - DNA, 17 bp; single-stranded, linear
gacuuguuugucuucca

SEQ ID NO: 593 - DNA, 17 bp; single-stranded, linear
uuguuugucuuccauuc

SEQ ID NO: 594 - DNA, 17 bp; single-stranded, linear
guuugucuuccauucca

SEQ ID NO: 595 - DNA, 17 bp; single-stranded, linear
uuugucuuccauuccau

SEQ ID NO: 596 - DNA, 17 bp; single-stranded, linear
ucuuccauuccauuguu

SEQ ID NO: 597 - DNA, 17 bp; single-stranded, linear
cuuccauuccauuguuu

SEQ ID NO: 598 - DNA, 17 bp; single-stranded, linear
cauuccauuguuuugaa

SEQ ID NO: 599 - DNA, 17 bp; single-stranded, linear
uccauuguuuugaaacu

SEQ ID NO: 600 - DNA, 17 bp; single-stranded, linear
ccauuguuuugaaacuc

SEQ ID NO: 601 - DNA, 17 bp; single-stranded, linear
cauuguuuugaaacuca

SEQ ID NO: 602 - DNA, 17 bp; single-stranded, linear
uugaaacucaguaugcc

SEQ ID NO: 603 - DNA, 17 bp; single-stranded, linear
aacucaguaugccgccc

SEQ ID NO: 604 - DNA, 17 bp; single-stranded, linear
gccccugucuugcuguc

SEQ ID NO: 605 - DNA, 17 bp; single-stranded, linear
cccugucuugcugucau

SEQ ID NO: 606 - DNA, 17 bp; single-stranded, linear
cuugcugucaugaaauc

SEQ ID NO: 607 - DNA, 17 bp; single-stranded, linear
caugaaaucagcaagag

SEQ ID NO: 608 - DNA, 17 bp; single-stranded, linear
ugacacaucaaauaaua

SEQ ID NO: 609 - DNA, 17 bp; single-stranded, linear
caucaaauaauaacucg

SEQ ID NO: 610 - DNA, 17 bp; single-stranded, linear
caaauaauaacucggau

SEQ ID NO: 611 - DNA, 17 bp; single-stranded, linear
uaauaacucggauucca

SEQ ID NO: 612 - DNA, 17 bp; single-stranded, linear
acucggauuccagccca

SEQ ID NO: 613 - DNA, 17 bp; single-stranded, linear
cucggauuccagcccac

SEQ ID NO: 614 - DNA, 17 bp; single-stranded, linear
gcccacauuggauucau

SEQ ID NO: 615 - DNA, 17 bp; single-stranded, linear
cauuggauucaucagca

SEQ ID NO: 616 - DNA, 17 bp; single-stranded, linear
auuggauucaucagcau

SEQ ID NO: 617 - DNA, 17 bp; single-stranded, linear
ggauucaucagcauuug

SEQ ID NO: 618 - DNA, 17 bp; single-stranded, linear
aucagcauuuggaccaa

SEQ ID NO: 619 - DNA, 17 bp; single-stranded, linear
ucagcauuuggaccaau

SEQ ID NO: 620 - DNA, 17 bp; single-stranded, linear
ggaccaauagcccacag

SEQ ID NO: 621 - DNA, 17 bp; single-stranded, linear
uguggaauaccuaagga

SEQ ID NO: 622 - DNA, 17 bp; single-stranded, linear
gaauaccuaaggauaac

SEQ ID NO: 623 - DNA, 17 bp; single-stranded, linear
cuaaggauaacaccgcu

SEQ ID NO: 624 - DNA, 17 bp; single-stranded, linear
acaccgcuuuuguucuc

SEQ ID NO: 625 - DNA, 17 bp; single-stranded, linear
caccgcuuuuguucucg

SEQ ID NO: 626 - DNA, 17 bp; single-stranded, linear
accgcuuuuguucucgc

SEQ ID NO: 627 - DNA, 17 bp; single-stranded, linear
gcuuuuguucucgcaaa

SEQ ID NO: 628 - DNA, 17 bp; single-stranded, linear
cuuuuguucucgcaaaa

SEQ ID NO: 629 - DNA, 17 bp; single-stranded, linear
uuuguucucgcaaaaac

SEQ ID NO: 630 - DNA, 17 bp; single-stranded, linear
aaaaacguaucuccuaa

SEQ ID NO: 631 - DNA, 17 bp; single-stranded, linear
aaacguaucuccuaauu

SEQ ID NO: 632 - DNA, 17 bp; single-stranded, linear
acguaucuccuaauuug

SEQ ID NO: 633 - DNA, 17 bp; single-stranded, linear
uaucuccuaauuugagg

SEQ ID NO: 634 - DNA, 17 bp; single-stranded, linear
cuccuaauuugaggcuc

SEQ ID NO: 635 - DNA, 17 bp; single-stranded, linear
uccuaauuugaggcuca

SEQ ID NO: 636 - DNA, 17 bp; single-stranded, linear
uugaggcucagaugaaa

SEQ ID NO: 637 - DNA, 17 bp; single-stranded, linear
aaaugcaucagguccuu

SEQ ID NO: 638 - DNA, 17 bp; single-stranded, linear
caucagguccuuugggg

SEQ ID NO: 639 - DNA, 17 bp; single-stranded, linear
cagguccuuuggggcau

SEQ ID NO: 640 - DNA, 17 bp; single-stranded, linear
agguccuuuggggcaua

SEQ ID NO: 641 - DNA, 17 bp; single-stranded, linear
uggggcauagaucagaa

SEQ ID NO: 642 - DNA, 17 bp; single-stranded, linear
gcauagaucagaagacu

SEQ ID NO: 643 - DNA, 17 bp; single-stranded, linear
agaagacuacaaaaaug

SEQ ID NO: 644 - DNA, 17 bp; single-stranded, linear
aagcugcucugaaaucu

SEQ ID NO: 645 - DNA, 17 bp; single-stranded, linear
ucugaaaucuccuuuag

SEQ ID NO: 646 - DNA, 17 bp; single-stranded, linear
ugaaaucuccuuuagcc

SEQ ID NO: 647 - DNA, 17 bp; single-stranded, linear
aaucuccuuuagccauc

SEQ ID NO: 648 - DNA, 17 bp; single-stranded, linear
aucuccuuuagccauca

SEQ ID NO: 649 - DNA, 17 bp; single-stranded, linear
ucuccuuuagccaucac

SEQ ID NO: 650 - DNA, 17 bp; single-stranded, linear
uuagccaucaccccaac

SEQ ID NO: 651 - DNA, 17 bp; single-stranded, linear
cccaaaauuaguuugug

SEQ ID NO: 652 - DNA, 17 bp; single-stranded, linear
ccaaaauuaguuugugu

SEQ ID NO: 653 - DNA, 17 bp; single-stranded, linear
aaauuaguuuguguuac

SEQ ID NO: 654 - DNA, 17 bp; single-stranded, linear
aauuaguuuguguuacu

SEQ ID NO: 655 - DNA, 17 bp; single-stranded, linear
guuuguguuacuuaugg

SEQ ID NO: 656 - DNA, 17 bp; single-stranded, linear
uuuguguuacuuaugga

SEQ ID NO: 657 - DNA, 17 bp; single-stranded, linear
guguuacuuauggaaga

SEQ ID NO: 658 - DNA, 17 bp; single-stranded, linear
uguuacuuauggaagau

SEQ ID NO: 659 - DNA, 17 bp; single-stranded, linear
uggaagauaguuuucuc

SEQ ID NO: 660 - DNA, 17 bp; single-stranded, linear
aagauaguuuucuccuu

SEQ ID NO: 661 - DNA, 17 bp; single-stranded, linear
agauaguuuucuccuuu

SEQ ID NO: 662 - DNA, 17 bp; single-stranded, linear
gauaguuuucuccuuuu

SEQ ID NO: 663 - DNA, 17 bp; single-stranded, linear
auaguuuucuccuuuua

SEQ ID NO: 664 - DNA, 17 bp; single-stranded, linear
aguuuucuccuuuuacu

SEQ ID NO: 665 - DNA, 17 bp; single-stranded, linear
uuucuccuuuuacuuca

SEQ ID NO: 666 - DNA, 17 bp; single-stranded, linear
uucuccuuuuacuucac

SEQ ID NO: 667 - DNA, 17 bp; single-stranded, linear
ucuccuuuuacuucacu

SEQ ID NO: 668 - DNA, 17 bp; single-stranded, linear
cuccuuuuacuucacuu

SEQ ID NO: 669 - DNA, 17 bp; single-stranded, linear
cuuuuacuucacuucaa

SEQ ID NO: 670 - DNA, 17 bp; single-stranded, linear
uuuuacuucacuucaaa

SEQ ID NO: 671 - DNA, 17 bp; single-stranded, linear
acuucacuucaaaagcu

SEQ ID NO: 672 - DNA, 17 bp; single-stranded, linear
cuucacuucaaaagcuu

SEQ ID NO: 673 - DNA, 17 bp; single-stranded, linear
caaaagcuuuuuacuca

SEQ ID NO: 674 - DNA, 17 bp; single-stranded, linear
aaaagcuuuuuacucaa

SEQ ID NO: 675 - DNA, 17 bp; single-stranded, linear
aaagcuuuuuacucaaa

SEQ ID NO: 676 - DNA, 17 bp; single-stranded, linear
aagcuuuuuacucaaag

SEQ ID NO: 677 - DNA, 17 bp; single-stranded, linear
agcuuuuuacucaaaga

SEQ ID NO: 678 - DNA, 17 bp; single-stranded, linear
uuuuuacucaaagagua

SEQ ID NO: 679 - DNA, 17 bp; single-stranded, linear
caaagaguauauguucc

SEQ ID NO: 680 - DNA, 17 bp; single-stranded, linear
aagaguauauguucccu

SEQ ID NO: 681 - DNA, 17 bp; single-stranded, linear
guauauguucccuccag

SEQ ID NO: 682 - DNA, 17 bp; single-stranded, linear
uauauguucccuccagg

SEQ ID NO: 683 - DNA, 17 bp; single-stranded, linear
uguucccuccaggucag

SEQ ID NO: 684 - DNA, 17 bp; single-stranded, linear
cuccaggucagcugccc

SEQ ID NO: 685 - DNA, 17 bp; single-stranded, linear
aacccccuccuuacgcu

SEQ ID NO: 686 - DNA, 17 bp; single-stranded, linear
ccccuccuuacgcuuug

SEQ ID NO: 687 - DNA, 17 bp; single-stranded, linear
cccuccuuacgcuuugu

SEQ ID NO: 688 - DNA, 17 bp; single-stranded, linear
cuuacgcuuugucacac

SEQ ID NO: 689 - DNA, 17 bp; single-stranded, linear
uuacgcuuugucacaca

SEQ ID NO: 690 - DNA, 17 bp; single-stranded, linear
cgcuuugucacacaaaa

SEQ ID NO: 691 - DNA, 17 bp; single-stranded, linear
aaaagugucucugccuu

SEQ ID NO: 692 - DNA, 17 bp; single-stranded, linear
aagugucucugccuuga

SEQ ID NO: 693 - DNA, 17 bp; single-stranded, linear
cucugccuugagucauc

SEQ ID NO: 694 - DNA, 17 bp; single-stranded, linear
ccuugagucaucuauuc

SEQ ID NO: 695 - DNA, 17 bp; single-stranded, linear
ugagucaucuauucaag

SEQ ID NO: 696 - DNA, 17 bp; single-stranded, linear
agucaucuauucaagca

SEQ ID NO: 697 - DNA, 17 bp; single-stranded, linear
ucaucuauucaagcacu

SEQ ID NO: 698 - DNA, 17 bp; single-stranded, linear
caucuauucaagcacuu

SEQ ID NO: 699 - DNA, 17 bp; single-stranded, linear
caagcacuuacagcucu

SEQ ID NO: 700 - DNA, 17 bp; single-stranded, linear
aagcacuuacagcucug

SEQ ID NO: 701 - DNA, 17 bp; single-stranded, linear
uuacagcucuggccaca

SEQ ID NO: 702 - DNA, 17 bp; single-stranded, linear
cagggcauuuuacaggu

SEQ ID NO: 703 - DNA, 17 bp; single-stranded, linear
agggcauuuuacaggug

SEQ ID NO: 704 - DNA, 17 bp; single-stranded, linear
gggcauuuuacaggugc

SEQ ID NO: 705 - DNA, 17 bp; single-stranded, linear
ggcauuuuacaggugcg

SEQ ID NO: 706 - DNA, 17 bp; single-stranded, linear
augacaguagcauuaug

SEQ ID NO: 707 - DNA, 17 bp; single-stranded, linear
aguagcauuaugaguag

SEQ ID NO: 708 - DNA, 17 bp; single-stranded, linear
guagcauuaugaguagu

SEQ ID NO: 709 - DNA, 17 bp; single-stranded, linear
uuaugaguagugugaau

SEQ ID NO: 710 - DNA, 17 bp; single-stranded, linear
gugugaauucagguagu

SEQ ID NO: 711 - DNA, 17 bp; single-stranded, linear
ugugaauucagguagua

SEQ ID NO: 712 - DNA, 17 bp; single-stranded, linear
auucagguaguaaauau

SEQ ID NO: 713 - DNA, 17 bp; single-stranded, linear
cagguaguaaauaugaa

SEQ ID NO: 714 - DNA, 17 bp; single-stranded, linear
uaguaaauaugaaacua

SEQ ID NO: 715 - DNA, 17 bp; single-stranded, linear
augaaacuaggguuuga

SEQ ID NO: 716 - DNA, 17 bp; single-stranded, linear
acuaggguuugaaauug

SEQ ID NO: 717 - DNA, 17 bp; single-stranded, linear
cuaggguuugaaauuga

SEQ ID NO: 718 - DNA, 17 bp; single-stranded, linear
uuugaaauugauaaugc

SEQ ID NO: 719 - DNA, 17 bp; single-stranded, linear
aaauugauaaugcuuuc

SEQ ID NO: 720 - DNA, 17 bp; single-stranded, linear
auaaugcuuucacaaca

SEQ ID NO: 721 - DNA, 17 bp; single-stranded, linear
uaaugcuuucacaacau

SEQ ID NO: 722 - DNA, 17 bp; single-stranded, linear
aaugcuuucacaacauu

SEQ ID NO: 723 - DNA, 17 bp; single-stranded, linear
cacaacauuugcagaug

SEQ ID NO: 724 - DNA, 17 bp; single-stranded, linear
acaacauuugcagaugu

SEQ ID NO: 725 - DNA, 17 bp; single-stranded, linear
gcagauguuuuagaagg

SEQ ID NO: 726 - DNA, 17 bp; single-stranded, linear
cagauguuuuagaagga

SEQ ID NO: 727 - DNA, 17 bp; single-stranded, linear
agauguuuuagaaggaa

SEQ ID NO: 728 - DNA, 17 bp; single-stranded, linear
gauguuuuagaaggaaa

SEQ ID NO: 729 - DNA, 17 bp; single-stranded, linear
aaaaaaguuccuuccua

SEQ ID NO: 730 - DNA, 17 bp; single-stranded, linear
aaaaaguuccuuccuaa

SEQ ID NO: 731 - DNA, 17 bp; single-stranded, linear
aaguuccuuccuaaaau

SEQ ID NO: 732 - DNA, 17 bp; single-stranded, linear
aguuccuuccuaaaaua

SEQ ID NO: 733 - DNA, 17 bp; single-stranded, linear
uccuuccuaaaauaauu

SEQ ID NO: 734 - DNA, 17 bp; single-stranded, linear
ccuaaaauaauuucucu

SEQ ID NO: 735 - DNA, 17 bp; single-stranded, linear
aaaauaauuucucuaca

SEQ ID NO: 736 - DNA, 17 bp; single-stranded, linear
aaauaauuucucuacaa

SEQ ID NO: 737 - DNA, 17 bp; single-stranded, linear
aauaauuucucuacaau

SEQ ID NO: 738 - DNA, 17 bp; single-stranded, linear
uaauuucucuacaauug

SEQ ID NO: 739 - DNA, 17 bp; single-stranded, linear
auuucucuacaauugga

SEQ ID NO: 740 - DNA, 17 bp; single-stranded, linear
ucuacaauuggaagauu

SEQ ID NO: 741 - DNA, 17 bp; single-stranded, linear
uggaagauuggaagauu

SEQ ID NO: 742 - DNA, 17 bp; single-stranded, linear
uggaagauucagcuagu

SEQ ID NO: 743 - DNA, 17 bp; single-stranded, linear
ggaagauucagcuaguu

SEQ ID NO: 744 - DNA, 17 bp; single-stranded, linear
auucagcuaguuaggag

SEQ ID NO: 745 - DNA, 17 bp; single-stranded, linear
cagcuaguuaggagccc

SEQ ID NO: 746 - DNA, 17 bp; single-stranded, linear
agcuaguuaggagccca

SEQ ID NO: 747 - DNA, 17 bp; single-stranded, linear
gagcccauuuuuuccua

SEQ ID NO: 748 - DNA, 17 bp; single-stranded, linear
agcccauuuuuuccuaa

SEQ ID NO: 749 - DNA, 17 bp; single-stranded, linear
gcccauuuuuuccuaau

SEQ ID NO: 750 - DNA, 17 bp; single-stranded, linear
cccauuuuuuccuaauc

SEQ ID NO: 751 - DNA, 17 bp; single-stranded, linear
ccauuuuuuccuaaucu

SEQ ID NO: 752 - DNA, 17 bp; single-stranded, linear
cauuuuuuccuaaucug

SEQ ID NO: 753 - DNA, 17 bp; single-stranded, linear
uuuuuccuaaucugugu

SEQ ID NO: 754 - DNA, 17 bp; single-stranded, linear
uuccuaaucugugugug

SEQ ID NO: 755 - DNA, 17 bp; single-stranded, linear
ugcccuguaaccugacu

SEQ ID NO: 756 - DNA, 17 bp; single-stranded, linear
ugacugguuaacagcag

SEQ ID NO: 757 - DNA, 17 bp; single-stranded, linear
gacugguuaacagcagu

SEQ ID NO: 758 - DNA, 17 bp; single-stranded, linear
acagcaguccuuuguaa

SEQ ID NO: 759 - DNA, 17 bp; single-stranded, linear
gcaguccuuuguaaaca

SEQ ID NO: 760 - DNA, 17 bp; single-stranded, linear
caguccuuuguaaacag

SEQ ID NO: 761 - DNA, 17 bp; single-stranded, linear
uccuuuguaaacagugu

SEQ ID NO: 762 - DNA, 17 bp; single-stranded, linear
aacaguguuuuaaacuc

SEQ ID NO: 763 - DNA, 17 bp; single-stranded, linear
acaguguuuuaaacucu

SEQ ID NO: 764 - DNA, 17 bp; single-stranded, linear
caguguuuuaaacucuc

SEQ ID NO: 765 - DNA, 17 bp; single-stranded, linear
aguguuuuaaacucucc

SEQ ID NO: 766 - DNA, 17 bp; single-stranded, linear
uuuaaacucuccuaguc

SEQ ID NO: 767 - DNA, 17 bp; single-stranded, linear
uaaacucuccuagucaa

SEQ ID NO: 768 - DNA, 17 bp; single-stranded, linear
acucuccuagucaauau

SEQ ID NO: 769 - DNA, 17 bp; single-stranded, linear
cuccuagucaauaucca

SEQ ID NO: 770 - DNA, 17 bp; single-stranded, linear
uagucaauauccacccc

SEQ ID NO: 771 - DNA, 17 bp; single-stranded, linear
gucaauauccaccccau

SEQ ID NO: 772 - DNA, 17 bp; single-stranded, linear
caccccauccaauuuau

SEQ ID NO: 773 - DNA, 17 bp; single-stranded, linear
cauccaauuuaucaagg

SEQ ID NO: 774 - DNA, 17 bp; single-stranded, linear
auccaauuuaucaagga

SEQ ID NO: 775 - DNA, 17 bp; single-stranded, linear
uccaauuuaucaaggaa

SEQ ID NO: 776 - DNA, 17 bp; single-stranded, linear
caauuuaucaaggaaga

SEQ ID NO: 777 - DNA, 17 bp; single-stranded, linear
gaaaugguucagaaaau

SEQ ID NO: 778 - DNA, 17 bp; single-stranded, linear
aaaugguucagaaaaua

SEQ ID NO: 779 - DNA, 17 bp; single-stranded, linear
cagaaaauauuuucagc

SEQ ID NO: 780 - DNA, 17 bp; single-stranded, linear
gaaaauauuuucagccu

SEQ ID NO: 781 - DNA, 17 bp; single-stranded, linear
aaaauauuuucagccua

SEQ ID NO: 782 - DNA, 17 bp; single-stranded, linear
aaauauuuucagccuac

SEQ ID NO: 783 - DNA, 17 bp; single-stranded, linear
aauauuuucagccuaca

SEQ ID NO: 784 - DNA, 17 bp; single-stranded, linear
uucagccuacaguuaug

SEQ ID NO: 785 - DNA, 17 bp; single-stranded, linear
ccuacaguuauguucag

SEQ ID NO: 786 - DNA, 17 bp; single-stranded, linear
cuacaguuauguucagu

SEQ ID NO: 787 - DNA, 17 bp; single-stranded, linear
aguuauguucagucaca

SEQ ID NO: 788 - DNA, 17 bp; single-stranded, linear
guuauguucagucacac

SEQ ID NO: 789 - DNA, 17 bp; single-stranded, linear
uguucagucacacacac

SEQ ID NO: 790 - DNA, 17 bp; single-stranded, linear
acacacauacaaaaugu

SEQ ID NO: 791 - DNA, 17 bp; single-stranded, linear
caaaauguuccuuuugc

SEQ ID NO: 792 - DNA, 17 bp; single-stranded, linear
aaaauguuccuuuugcu

SEQ ID NO: 793 - DNA, 17 bp; single-stranded, linear
auguuccuuuugcuuuu

SEQ ID NO: 794 - DNA, 17 bp; single-stranded, linear
uguuccuuuugcuuuua

SEQ ID NO: 795 - DNA, 17 bp; single-stranded, linear
guuccuuuugcuuuuaa

SEQ ID NO: 796 - DNA, 17 bp; single-stranded, linear
cuuuugcuuuuaaagua

SEQ ID NO: 797 - DNA, 17 bp; single-stranded, linear
uuuugcuuuuaaaguaa

SEQ ID NO: 798 - DNA, 17 bp; single-stranded, linear
uuugcuuuuaaaguaau

SEQ ID NO: 799 - DNA, 17 bp; single-stranded, linear
uugcuuuuaaaguaauu

SEQ ID NO: 800 - DNA, 17 bp; single-stranded, linear
uuuaaaguaauuuuuga

SEQ ID NO: 801 - DNA, 17 bp; single-stranded, linear
aaaguaauuuuugacuc

SEQ ID NO: 802 - DNA, 17 bp; single-stranded, linear
aaguaauuuuugacucc

SEQ ID NO: 803 - DNA, 17 bp; single-stranded, linear
aguaauuuuugacuccc

SEQ ID NO: 804 - DNA, 17 bp; single-stranded, linear
guaauuuuugacuccca

SEQ ID NO: 805 - DNA, 17 bp; single-stranded, linear
uuuugacucccagauca

SEQ ID NO: 806 - DNA, 17 bp; single-stranded, linear
ucccagaucagucagag

SEQ ID NO: 807 - DNA, 17 bp; single-stranded, linear
agaucagucagagcccc

SEQ ID NO: 808 - DNA, 17 bp; single-stranded, linear
gagccccuacagcauug

SEQ ID NO: 809 - DNA, 17 bp; single-stranded, linear
uacagcauuguuaagaa

SEQ ID NO: 810 - DNA, 17 bp; single-stranded, linear
agcauuguuaagaaagu

SEQ ID NO: 811 - DNA, 17 bp; single-stranded, linear
gcauuguuaagaaagua

SEQ ID NO: 812 - DNA, 17 bp; single-stranded, linear
aagaaaguauuugauuu

SEQ ID NO: 813 - DNA, 17 bp; single-stranded, linear
gaaaguauuugauuuuu

SEQ ID NO: 814 - DNA, 17 bp; single-stranded, linear
aaaguauuugauuuuug

SEQ ID NO: 815 - DNA, 17 bp; single-stranded, linear
uauuugauuuuugucuc

SEQ ID NO: 816 - DNA, 17 bp; single-stranded, linear
auuugauuuuugucuca

SEQ ID NO: 817 - DNA, 17 bp; single-stranded, linear
uuugauuuuugucucaa

SEQ ID NO: 818 - DNA, 17 bp; single-stranded, linear
uugauuuuugucucaau

SEQ ID NO: 819 - DNA, 17 bp; single-stranded, linear
auuuuugucucaaugaa

SEQ ID NO: 820 - DNA, 17 bp; single-stranded, linear
uuuugucucaaugaaaa

SEQ ID NO: 821 - DNA, 17 bp; single-stranded, linear
augaaaauaaaacuaua

SEQ ID NO: 822 - DNA, 17 bp; single-stranded, linear
auaaaacuauauucauu

SEQ ID NO: 823 - DNA, 17 bp; single-stranded, linear
aaaacuauauucauuuc

SEQ ID NO: 824 - DNA, 27 bp; single-stranded, linear
  The letter "N" stands for the stem II region of a HH ribozyme.
uagcucggcugaugangaaacuccggc

SEQ ID NO: 825 - DNA, 27 bp; single-stranded, linear
  The letter "N" stands for the stem II region of a HH ribozyme.
gccggggccugaugangaaagcucggg

SEQ ID NO: 826 - DNA, 27 bp; single-stranded, linear
  The letter "N" stands for the stem II region of a HH ribozyme.
acgccgaccugaugangaaagguggcc

SEQ ID NO: 827 - DNA, 27 bp; single-stranded, linear
  The letter "N" stands for the stem II region of a HH ribozyme.
cggacgcccugaugangaaacgaggug

SEQ ID NO: 828 - DNA, 27 bp; single-stranded, linear
  The letter "N" stands for the stem II region of a HH ribozyme.
cucgggcgcugaugangaaacgccgac

SEQ ID NO: 829 - DNA, 27 bp; single-stranded, linear
  The letter "N" stands for the stem II region of a HH ribozyme.
gaggcgggcugaugangaaacucgggc

SEQ ID NO: 830 - DNA, 27 bp; single-stranded, linear
  The letter "N" stands for the stem II region of a HH ribozyme.
uuggcggccugaugangaaaggcgggg

SEQ ID NO: 831 - DNA, 27 bp; single-stranded, linear
  The letter "N" stands for the stem II region of a HH ribozyme.
acuggacgcugaugangaaagucaggg

SEQ ID NO: 832 - DNA, 27 bp; single-stranded, linear
  The letter "N" stands for the stem II region of a HH ribozyme.
caauacugcugaugangaaacggaguc

SEQ ID NO: 833 - DNA, 27 bp; single-stranded, linear
  The letter "N" stands for the stem II region of a HH ribozyme.
ccgaucaacugaugangaaacuggacg

SEQ ID NO: 834 - DNA, 27 bp; single-stranded, linear
  The letter "N" stands for the stem II region of a HH ribozyme.
ucccgauccugaugangaaauacugga

SEQ ID NO: 835 - DNA, 27 bp; single-stranded, linear
  The letter "N" stands for the stem II region of a HH ribozyme.
gcucuccccugaugangaaaucaauac

SEQ ID NO: 836 - DNA, 27 bp; single-stranded, linear
  The letter "N" stands for the stem II region of a HH ribozyme.
uccccgaacugaugangaaagcucgcu

SEQ ID NO: 837 - DNA, 27 bp; single-stranded, linear
  The letter "N" stands for the stem II region of a HH ribozyme.
gcuccccgcugaugangaaagagcucg

SEQ ID NO: 838 - DNA, 27 bp; single-stranded, linear
  The letter "N" stands for the stem II region of a HH ribozyme.
ugcucccccugaugangaaaagagcuc

SEQ ID NO: 839 - DNA, 27 bp; single-stranded, linear
  The letter "N" stands for the stem II region of a HH ribozyme.
ccgucccgcugaugangaaagggucgc

SEQ ID NO: 840 - DNA, 27 bp; single-stranded, linear
  The letter "N" stands for the stem II region of a HH ribozyme.
agcgccagcugaugangaaagcgcugc

SEQ ID NO: 841 - DNA, 27 bp; single-stranded, linear
  The letter "N" stands for the stem II region of a HH ribozyme.
gccgggcacugaugangaaagcgcagc

SEQ ID NO: 842 - DNA, 27 bp; single-stranded, linear
  The letter "N" stands for the stem II region of a HH ribozyme.
cagagccccugaugangaaacucgccg

SEQ ID NO: 843 - DNA, 27 bp; single-stranded, linear
  The letter "N" stands for the stem II region of a HH ribozyme.
uuccuccacugaugangaaagcccgac

SEQ ID NO: 844 - DNA, 27 bp; single-stranded, linear
  The letter "N" stands for the stem II region of a HH ribozyme.
ccuuggcacugaugangaaacuuucuu

SEQ ID NO: 845 - DNA, 27 bp; single-stranded, linear
  The letter "N" stands for the stem II region of a HH ribozyme.
gccuuggccugaugangaaaacuuucu

SEQ ID NO: 846 - DNA, 27 bp; single-stranded, linear
  The letter "N" stands for the stem II region of a HH ribozyme.
gagcuugucugaugangaaacucgugc

SEQ ID NO: 847 - DNA, 27 bp; single-stranded, linear
  The letter "N" stands for the stem II region of a HH ribozyme.
aacugcgucugaugangaaagcuuguu

SEQ ID NO: 848 - DNA, 27 bp; single-stranded, linear
  The letter "N" stands for the stem II region of a HH ribozyme.
aagugccccugaugangaaacugcgug

SEQ ID NO: 849 - DNA, 27 bp; single-stranded, linear
  The letter "N" stands for the stem II region of a HH ribozyme.
aucuucaacugaugangaaagugccca

SEQ ID NO: 850 - DNA, 27 bp; single-stranded, linear
  The letter "N" stands for the stem II region of a HH ribozyme.
gaucuucacugaugangaaaagugccc

SEQ ID NO: 851 - DNA, 27 bp; single-stranded, linear
  The letter "N" stands for the stem II region of a HH ribozyme.
ugaucuuccugaugangaaaaagugcc

SEQ ID NO: 852 - DNA, 27 bp; single-stranded, linear
  The letter "N" stands for the stem II region of a HH ribozyme.
gagaaaaucugaugangaaaucuucaa

SEQ ID NO: 853 - DNA, 27 bp; single-stranded, linear
  The letter "N" stands for the stem II region of a HH ribozyme.
gcugagaacugaugangaaaugaucuu

SEQ ID NO: 854 - DNA, 27 bp; single-stranded, linear
  The letter "N" stands for the stem II region of a HH ribozyme.
ggcugagacugaugangaaaaugaucu

SEQ ID NO: 855 - DNA, 27 bp; single-stranded, linear
  The letter "N" stands for the stem II region of a HH ribozyme.
aggcugagcugaugangaaaaaugauc

SEQ ID NO: 856 - DNA, 27 bp; single-stranded, linear
  The letter "N" stands for the stem II region of a HH ribozyme.
gaggcugacugaugangaaaaaaugau

SEQ ID NO: 857 - DNA, 27 bp; single-stranded, linear
  The letter "N" stands for the stem II region of a HH ribozyme.
uggaggcucugaugangaaagaaaaug

SEQ ID NO: 858 - DNA, 27 bp; single-stranded, linear
  The letter "N" stands for the stem II region of a HH ribozyme.
auccucugcugaugangaaaggcugag

SEQ ID NO: 859 - DNA, 27 bp; single-stranded, linear
  The letter "N" stands for the stem II region of a HH ribozyme.
aguuauugcugaugangaaacauccuc

SEQ ID NO: 860 - DNA, 27 bp; single-stranded, linear
  The letter "N" stands for the stem II region of a HH ribozyme.
caguuauucugaugangaaaacauccu

SEQ ID NO: 861 - DNA, 27 bp; single-stranded, linear
  The letter "N" stands for the stem II region of a HH ribozyme.
cucacagucugaugangaaauugaaca

SEQ ID NO: 862 - DNA, 27 bp; single-stranded, linear
  The letter "N" stands for the stem II region of a HH ribozyme.
uucccaagcugaugangaaaccaccuc

SEQ ID NO: 863 - DNA, 27 bp; single-stranded, linear
  The letter "N" stands for the stem II region of a HH ribozyme.
aaauuccccugaugangaaaggaccac

SEQ ID NO: 864 - DNA, 27 bp; single-stranded, linear
  The letter "N" stands for the stem II region of a HH ribozyme.
aauuuccacugaugangaaauucccaa

SEQ ID NO: 865 - DNA, 27 bp; single-stranded, linear
  The letter "N" stands for the stem II region of a HH ribozyme.
uaauuucccugaugangaaaauuccca

SEQ ID NO: 866 - DNA, 27 bp; single-stranded, linear
  The letter "N" stands for the stem II region of a HH ribozyme.
acauaggucugaugangaaauuuccaa

SEQ ID NO: 867 - DNA, 27 bp; single-stranded, linear
  The letter "N" stands for the stem II region of a HH ribozyme.
cacauaggcugaugangaaaauuucca

SEQ ID NO: 868 - DNA, 27 bp; single-stranded, linear
  The letter "N" stands for the stem II region of a HH ribozyme.
ucugcacacugaugangaaagguaauu

SEQ ID NO: 869 - DNA, 27 bp; single-stranded, linear
  The letter "N" stands for the stem II region of a HH ribozyme.
aagaucaucugaugangaaauuccucu

SEQ ID NO: 870 - DNA, 27 bp; single-stranded, linear
  The letter "N" stands for the stem II region of a HH ribozyme.
aaagaucacugaugangaaaauuccuc

SEQ ID NO: 871 - DNA, 27 bp; single-stranded, linear
  The letter "N" stands for the stem II region of a HH ribozyme.
gaaggaaacugaugangaaaucauaau

SEQ ID NO: 872 - DNA, 27 bp; single-stranded, linear
  The letter "N" stands for the stem II region of a HH ribozyme.
aagaaggacugaugangaaagaucaua

SEQ ID NO: 873 - DNA, 27 bp; single-stranded, linear
  The letter "N" stands for the stem II region of a HH ribozyme.
uaagaaggcugaugangaaaagaucau

SEQ ID NO: 874 - DNA, 27 bp; single-stranded, linear
  The letter "N" stands for the stem II region of a HH ribozyme.
uuaagaagcugaugangaaaaagauca

SEQ ID NO: 875 - DNA, 27 bp; single-stranded, linear
  The letter "N" stands for the stem II region of a HH ribozyme.
ucuuuaagcugaugangaaaggaaaga

SEQ ID NO: 876 - DNA, 27 bp; single-stranded, linear
  The letter "N" stands for the stem II region of a HH ribozyme.
gucuuuaacugaugangaaaaggaaag

SEQ ID NO: 877 - DNA, 27 bp; single-stranded, linear
  The letter "N" stands for the stem II region of a HH ribozyme.
uggucuuucugaugangaaagaaggaa

SEQ ID NO: 878 - DNA, 27 bp; single-stranded, linear
  The letter "N" stands for the stem II region of a HH ribozyme.
auggucuucugaugangaaaagaagga

SEQ ID NO: 879 - DNA, 27 bp; single-stranded, linear
  The letter "N" stands for the stem II region of a HH ribozyme.
accuccugcugaugangaaauggucuu

SEQ ID NO: 880 - DNA, 27 bp; single-stranded, linear
  The letter "N" stands for the stem II region of a HH ribozyme.
gaggacaucugaugangaaaccagcca

SEQ ID NO: 881 - DNA, 27 bp; single-stranded, linear
  The letter "N" stands for the stem II region of a HH ribozyme.
ugaggacacugaugangaaaaccagcc

SEQ ID NO: 882 - DNA, 27 bp; single-stranded, linear
  The letter "N" stands for the stem II region of a HH ribozyme.
gcaaugagcugaugangaaacauaacc

SEQ ID NO: 883 - DNA, 27 bp; single-stranded, linear
  The letter "N" stands for the stem II region of a HH ribozyme.
agggcaaucugaugangaaaggacaua

SEQ ID NO: 884 - DNA, 27 bp; single-stranded, linear
  The letter "N" stands for the stem II region of a HH ribozyme.
uugagggccugaugangaaaugaggac

SEQ ID NO: 885 - DNA, 27 bp; single-stranded, linear
  The letter "N" stands for the stem II region of a HH ribozyme.
acuguguucugaugangaaagggcaau

SEQ ID NO: 886 - DNA, 27 bp; single-stranded, linear
  The letter "N" stands for the stem II region of a HH ribozyme.
uccaaaggcugaugangaaauucgcuc

SEQ ID NO: 887 - DNA, 27 bp; single-stranded, linear
  The letter "N" stands for the stem II region of a HH ribozyme.
uuccaaagcugaugangaaaauucgcu

SEQ ID NO: 888 - DNA, 27 bp; single-stranded, linear
  The letter "N" stands for the stem II region of a HH ribozyme.
guuuuccacugaugangaaaggaauuc

SEQ ID NO: 889 - DNA, 27 bp; single-stranded, linear
  The letter "N" stands for the stem II region of a HH ribozyme.
gguuuucccugaugangaaaaggaauu

SEQ ID NO: 890 - DNA, 27 bp; single-stranded, linear
  The letter "N" stands for the stem II region of a HH ribozyme.
ccucugaucugaugangaaaucugcag

SEQ ID NO: 891 - DNA, 27 bp; single-stranded, linear
  The letter "N" stands for the stem II region of a HH ribozyme.
uuuccucucugaugangaaaugaucug

SEQ ID NO: 892 - DNA, 27 bp; single-stranded, linear
  The letter "N" stands for the stem II region of a HH ribozyme.
guaguacacugaugangaaauuuccuc

SEQ ID NO: 893 - DNA, 27 bp; single-stranded, linear
  The letter "N" stands for the stem II region of a HH ribozyme.
uuucguagcugaugangaaacauauuu

SEQ ID NO: 894 - DNA, 27 bp; single-stranded, linear
  The letter "N" stands for the stem II region of a HH ribozyme.
aauuuucgcugaugangaaaguacaua

SEQ ID NO: 895 - DNA, 27 bp; single-stranded, linear
  The letter "N" stands for the stem II region of a HH ribozyme.
ggcauaggcugaugangaaauuuucgu

SEQ ID NO: 896 - DNA, 27 bp; single-stranded, linear
  The letter "N" stands for the stem II region of a HH ribozyme.
aggcauagcugaugangaaaauuuucg

SEQ ID NO: 897 - DNA, 27 bp; single-stranded, linear
  The letter "N" stands for the stem II region of a HH ribozyme.
cuaaggcacugaugangaaaggaauuu

SEQ ID NO: 898 - DNA, 27 bp; single-stranded, linear
  The letter "N" stands for the stem II region of a HH ribozyme.
agacugcucugaugangaaaggcauag

SEQ ID NO: 899 - DNA, 27 bp; single-stranded, linear
  The letter "N" stands for the stem II region of a HH ribozyme.
aagacugccugaugangaaaaggcaua

SEQ ID NO: 900 - DNA, 27 bp; single-stranded, linear
  The letter "N" stands for the stem II region of a HH ribozyme.
uuagauaacugaugangaaacugcuaa

SEQ ID NO: 901 - DNA, 27 bp; single-stranded, linear
  The letter "N" stands for the stem II region of a HH ribozyme.
aguuagaucugaugangaaagacugcu

SEQ ID NO: 902 - DNA, 27 bp; single-stranded, linear
  The letter "N" stands for the stem II region of a HH ribozyme.
uaguuagacugaugangaaaagacugc

SEQ ID NO: 903 - DNA, 27 bp; single-stranded, linear
  The letter "N" stands for the stem II region of a HH ribozyme.
cauaguuacugaugangaaauaagacu

SEQ ID NO: 904 - DNA, 27 bp; single-stranded, linear
  The letter "N" stands for the stem II region of a HH ribozyme.
aucauagucugaugangaaagauaaga

SEQ ID NO: 905 - DNA, 27 bp; single-stranded, linear
  The letter "N" stands for the stem II region of a HH ribozyme.
uugcaucacugaugangaaaguuagau

SEQ ID NO: 906 - DNA, 27 bp; single-stranded, linear
  The letter "N" stands for the stem II region of a HH ribozyme.
uccgguuucugaugangaaauuugcau

SEQ ID NO: 907 - DNA, 27 bp; single-stranded, linear
  The letter "N" stands for the stem II region of a HH ribozyme.
uuccuguacugaugangaaauuucuca

SEQ ID NO: 908 - DNA, 27 bp; single-stranded, linear
  The letter "N" stands for the stem II region of a HH ribozyme.
uuuccugucugaugangaaaauuucuc

SEQ ID NO: 909 - DNA, 27 bp; single-stranded, linear
  The letter "N" stands for the stem II region of a HH ribozyme.
auuuccugcugaugangaaaaauuucu

SEQ ID NO: 910 - DNA, 27 bp; single-stranded, linear
  The letter "N" stands for the stem II region of a HH ribozyme.
ccaugcagcugaugangaaauuuccug

SEQ ID NO: 911 - DNA, 27 bp; single-stranded, linear
  The letter "N" stands for the stem II region of a HH ribozyme.
uguugcugcugaugangaaaccgcacg

SEQ ID NO: 912 - DNA, 27 bp; single-stranded, linear
  The letter "N" stands for the stem II region of a HH ribozyme.
uuguugcucugaugangaaaaccgcac

SEQ ID NO: 913 - DNA, 27 bp; single-stranded, linear
  The letter "N" stands for the stem II region of a HH ribozyme.
cgccacugcugaugangaaaugcucuc

SEQ ID NO: 914 - DNA, 27 bp; single-stranded, linear
  The letter "N" stands for the stem II region of a HH ribozyme.
cugcugaccugaugangaaaugucccg

SEQ ID NO: 915 - DNA, 27 bp; single-stranded, linear
  The letter "N" stands for the stem II region of a HH ribozyme.
ucacugcucugaugangaaacuauguc

SEQ ID NO: 916 - DNA, 27 bp; single-stranded, linear
  The letter "N" stands for the stem II region of a HH ribozyme.
ugcugagacugaugangaaagucacug

SEQ ID NO: 917 - DNA, 27 bp; single-stranded, linear
  The letter "N" stands for the stem II region of a HH ribozyme.
uugcugagcugaugangaaaagucacu

SEQ ID NO: 918 - DNA, 27 bp; single-stranded, linear
  The letter "N" stands for the stem II region of a HH ribozyme.
guugcugacugaugangaaaaagucac

SEQ ID NO: 919 - DNA, 27 bp; single-stranded, linear
  The letter "N" stands for the stem II region of a HH ribozyme.
auguugcucugaugangaaagaaaguc

SEQ ID NO: 920 - DNA, 27 bp; single-stranded, linear
  The letter "N" stands for the stem II region of a HH ribozyme.
aguccauccugaugangaaacauguug

SEQ ID NO: 921 - DNA, 27 bp; single-stranded, linear
  The letter "N" stands for the stem II region of a HH ribozyme.
gguucuggcugaugangaaaguccauc

SEQ ID NO: 922 - DNA, 27 bp; single-stranded, linear
  The letter "N" stands for the stem II region of a HH ribozyme.
ugguucugcugaugangaaaaguccau

SEQ ID NO: 923 - DNA, 27 bp; single-stranded, linear
  The letter "N" stands for the stem II region of a HH ribozyme.
acagcuugcugaugangaaaucacacu

SEQ ID NO: 924 - DNA, 27 bp; single-stranded, linear
  The letter "N" stands for the stem II region of a HH ribozyme.
cccauuggcugaugangaaacagcuug

SEQ ID NO: 925 - DNA, 27 bp; single-stranded, linear
  The letter "N" stands for the stem II region of a HH ribozyme.
gcacagaucugaugangaaauuuuggu

SEQ ID NO: 926 - DNA, 27 bp; single-stranded, linear
  The letter "N" stands for the stem II region of a HH ribozyme.
ugggcacacugaugangaaaugauuuu

SEQ ID NO: 927 - DNA, 27 bp; single-stranded, linear
  The letter "N" stands for the stem II region of a HH ribozyme.
agcgcccgcugaugangaaagcacugc

SEQ ID NO: 928 - DNA, 27 bp; single-stranded, linear
  The letter "N" stands for the stem II region of a HH ribozyme.
cacuggggcugaugangaaacuugcca

SEQ ID NO: 929 - DNA, 27 bp; single-stranded, linear
  The letter "N" stands for the stem II region of a HH ribozyme.
uugcggcacugaugangaaaccaggca

SEQ ID NO: 930 - DNA, 27 bp; single-stranded, linear
  The letter "N" stands for the stem II region of a HH ribozyme.
cgucucggcugaugangaaauuugcgg

SEQ ID NO: 931 - DNA, 27 bp; single-stranded, linear
  The letter "N" stands for the stem II region of a HH ribozyme.
ucgucucgcugaugangaaaauuugcg

SEQ ID NO: 932 - DNA, 27 bp; single-stranded, linear
  The letter "N" stands for the stem II region of a HH ribozyme.
uagagcaucugaugangaaaguggggg

SEQ ID NO: 933 - DNA, 27 bp; single-stranded, linear
  The letter "N" stands for the stem II region of a HH ribozyme.
ggguuguacugaugangaaagcaugag

SEQ ID NO: 934 - DNA, 27 bp; single-stranded, linear
  The letter "N" stands for the stem II region of a HH ribozyme.
ugggguugcugaugangaaagagcaug

SEQ ID NO: 935 - DNA, 27 bp; single-stranded, linear
  The letter "N" stands for the stem II region of a HH ribozyme.
ccaucuggcugaugangaaacguggug

SEQ ID NO: 936 - DNA, 27 bp; single-stranded, linear
  The letter "N" stands for the stem II region of a HH ribozyme.
caaagcugcugaugangaaauuugccc

SEQ ID NO: 937 - DNA, 27 bp; single-stranded, linear
  The letter "N" stands for the stem II region of a HH ribozyme.
uggcaccacugaugangaaagcuguau

SEQ ID NO: 938 - DNA, 27 bp; single-stranded, linear
  The letter "N" stands for the stem II region of a HH ribozyme.
guggcacccugaugangaaaagcugua

SEQ ID NO: 939 - DNA, 27 bp; single-stranded, linear
  The letter "N" stands for the stem II region of a HH ribozyme.
auuacgggcugaugangaaacacuucu

SEQ ID NO: 940 - DNA, 27 bp; single-stranded, linear
  The letter "N" stands for the stem II region of a HH ribozyme.
cacauaaucugaugangaaacggggac

SEQ ID NO: 941 - DNA, 27 bp; single-stranded, linear
  The letter "N" stands for the stem II region of a HH ribozyme.
caccacaucugaugangaaauuacggg

SEQ ID NO: 942 - DNA, 27 bp; single-stranded, linear
  The letter "N" stands for the stem II region of a HH ribozyme.
ucaccacacugaugangaaaauuacgg

SEQ ID NO: 943 - DNA, 27 bp; single-stranded, linear
  The letter "N" stands for the stem II region of a HH ribozyme.
cgagccgucugaugangaaaucuguca

SEQ ID NO: 944 - DNA, 27 bp; single-stranded, linear
  The letter "N" stands for the stem II region of a HH ribozyme.
ggacgcaccugaugangaaagccguga

SEQ ID NO: 945 - DNA, 27 bp; single-stranded, linear
  The letter "N" stands for the stem II region of a HH ribozyme.
caggcucgcugaugangaaacgcacga

SEQ ID NO: 946 - DNA, 27 bp; single-stranded, linear
  The letter "N" stands for the stem II region of a HH ribozyme.
ccaucucacugaugangaaagcugucg

SEQ ID NO: 947 - DNA, 27 bp; single-stranded, linear
  The letter "N" stands for the stem II region of a HH ribozyme.
cacuugcgcugaugangaaacgccguc

SEQ ID NO: 948 - DNA, 27 bp; single-stranded, linear
  The letter "N" stands for the stem II region of a HH ribozyme.
gcacuucucugaugangaaacacuugc

SEQ ID NO: 949 - DNA, 27 bp; single-stranded, linear
  The letter "N" stands for the stem II region of a HH ribozyme.
uuugcggccugaugangaaaggcccuu

SEQ ID NO: 950 - DNA, 27 bp; single-stranded, linear
  The letter "N" stands for the stem II region of a HH ribozyme.
uauuccgucugaugangaaacacacuu

SEQ ID NO: 951 - DNA, 27 bp; single-stranded, linear
  The letter "N" stands for the stem II region of a HH ribozyme.
ccaauacccugaugangaaauuccguu

SEQ ID NO: 952 - DNA, 27 bp; single-stranded, linear
  The letter "N" stands for the stem II region of a HH ribozyme.
uucaccaacugaugangaaaccuauuc

SEQ ID NO: 953 - DNA, 27 bp; single-stranded, linear
  The letter "N" stands for the stem II region of a HH ribozyme.
aauucacccugaugangaaauaccuau

SEQ ID NO: 954 - DNA, 27 bp; single-stranded, linear
  The letter "N" stands for the stem II region of a HH ribozyme.
agucuuuacugaugangaaauucacca

SEQ ID NO: 955 - DNA, 27 bp; single-stranded, linear
  The letter "N" stands for the stem II region of a HH ribozyme.
gagucuuucugaugangaaaauucacc

SEQ ID NO: 956 - DNA, 27 bp; single-stranded, linear
  The letter "N" stands for the stem II region of a HH ribozyme.
ugagucuucugaugangaaaaauucac

SEQ ID NO: 957 - DNA, 27 bp; single-stranded, linear
  The letter "N" stands for the stem II region of a HH ribozyme.
uggagagucugaugangaaagucuuua

SEQ ID NO: 958 - DNA, 27 bp; single-stranded, linear
  The letter "N" stands for the stem II region of a HH ribozyme.
uuuauggacugaugangaaagugaguc

SEQ ID NO: 959 - DNA, 27 bp; single-stranded, linear
  The letter "N" stands for the stem II region of a HH ribozyme.
cauuuaugcugaugangaaagagugag

SEQ ID NO: 960 - DNA, 27 bp; single-stranded, linear
  The letter "N" stands for the stem II region of a HH ribozyme.
guagcauucugaugangaaauggagag

SEQ ID NO: 961 - DNA, 27 bp; single-stranded, linear
  The letter "N" stands for the stem II region of a HH ribozyme.
aauauucgcugaugangaaagcauuua

SEQ ID NO: 962 - DNA, 27 bp; single-stranded, linear
  The letter "N" stands for the stem II region of a HH ribozyme.
guguuuaacugaugangaaauucguag

SEQ ID NO: 963 - DNA, 27 bp; single-stranded, linear
  The letter "N" stands for the stem II region of a HH ribozyme.
aaguguuucugaugangaaauauucgu

SEQ ID NO: 964 - DNA, 27 bp; single-stranded, linear
  The letter "N" stands for the stem II region of a HH ribozyme.
gaaguguucugaugangaaaauauucg

SEQ ID NO: 965 - DNA, 27 bp; single-stranded, linear
  The letter "N" stands for the stem II region of a HH ribozyme.
aguuuuugcugaugangaaaguguuua

SEQ ID NO: 966 - DNA, 27 bp; single-stranded, linear
  The letter "N" stands for the stem II region of a HH ribozyme.
caguuuuucugaugangaaaaguguuu

SEQ ID NO: 967 - DNA, 27 bp; single-stranded, linear
  The letter "N" stands for the stem II region of a HH ribozyme.
cacugaugcugaugangaaaggugcag

SEQ ID NO: 968 - DNA, 27 bp; single-stranded, linear
  The letter "N" stands for the stem II region of a HH ribozyme.
ucgccacucugaugangaaauggaggu

SEQ ID NO: 969 - DNA, 27 bp; single-stranded, linear
  The letter "N" stands for the stem II region of a HH ribozyme.
gauguggacugaugangaaaucgccac

SEQ ID NO: 970 - DNA, 27 bp; single-stranded, linear
  The letter "N" stands for the stem II region of a HH ribozyme.
aggaugugcugaugangaaagaucgcc

SEQ ID NO: 971 - DNA, 27 bp; single-stranded, linear
  The letter "N" stands for the stem II region of a HH ribozyme.
accggcagcugaugangaaauguggag

SEQ ID NO: 972 - DNA, 27 bp; single-stranded, linear
  The letter "N" stands for the stem II region of a HH ribozyme.
caccccuacugaugangaaaugccacc

SEQ ID NO: 973 - DNA, 27 bp; single-stranded, linear
  The letter "N" stands for the stem II region of a HH ribozyme.
ucaccccucugaugangaaaaugccac

SEQ ID NO: 974 - DNA, 27 bp; single-stranded, linear
  The letter "N" stands for the stem II region of a HH ribozyme.
gucacccccugaugangaaaaaugcca

SEQ ID NO: 975 - DNA, 27 bp; single-stranded, linear
  The letter "N" stands for the stem II region of a HH ribozyme.
gugugaagcugaugangaaagucaccc

SEQ ID NO: 976 - DNA, 27 bp; single-stranded, linear
  The letter "N" stands for the stem II region of a HH ribozyme.
uaugugugcugaugangaaaggaguca

SEQ ID NO: 977 - DNA, 27 bp; single-stranded, linear
  The letter "N" stands for the stem II region of a HH ribozyme.
guaugugucugaugangaaaaggaguc

SEQ ID NO: 978 - DNA, 27 bp; single-stranded, linear
  The letter "N" stands for the stem II region of a HH ribozyme.
aggaggagcugaugangaaauguguga

SEQ ID NO: 979 - DNA, 27 bp; single-stranded, linear
  The letter "N" stands for the stem II region of a HH ribozyme.
cagaggagcugaugangaaaguaugug

SEQ ID NO: 980 - DNA, 27 bp; single-stranded, linear
  The letter "N" stands for the stem II region of a HH ribozyme.
auccagagcugaugangaaaggaguau

SEQ ID NO: 981 - DNA, 27 bp; single-stranded, linear
  The letter "N" stands for the stem II region of a HH ribozyme.
uggauccacugaugangaaaggaggag

SEQ ID NO: 982 - DNA, 27 bp; single-stranded, linear
  The letter "N" stands for the stem II region of a HH ribozyme.
uuccugugcugaugangaaauccagag

SEQ ID NO: 983 - DNA, 27 bp; single-stranded, linear
  The letter "N" stands for the stem II region of a HH ribozyme.
uuucagaacugaugangaaauccaguu

SEQ ID NO: 984 - DNA, 27 bp; single-stranded, linear
  The letter "N" stands for the stem II region of a HH ribozyme.
guuuucagcugaugangaaauauccag

SEQ ID NO: 985 - DNA, 27 bp; single-stranded, linear
  The letter "N" stands for the stem II region of a HH ribozyme.
gguuuucacugaugangaaaauaucca

SEQ ID NO: 986 - DNA, 27 bp; single-stranded, linear
  The letter "N" stands for the stem II region of a HH ribozyme.
auuuccuucugaugangaaacgguuuu

SEQ ID NO: 987 - DNA, 27 bp; single-stranded, linear
  The letter "N" stands for the stem II region of a HH ribozyme.
aacccugucugaugangaaauuuccuu

SEQ ID NO: 988 - DNA, 27 bp; single-stranded, linear
  The letter "N" stands for the stem II region of a HH ribozyme.
ucagcaaacugaugangaaacccugug

SEQ ID NO: 989 - DNA, 27 bp; single-stranded, linear
  The letter "N" stands for the stem II region of a HH ribozyme.
aucagcaacugaugangaaaacccugu

SEQ ID NO: 990 - DNA, 27 bp; single-stranded, linear
  The letter "N" stands for the stem II region of a HH ribozyme.
aaucagcacugaugangaaaaacccug

SEQ ID NO: 991 - DNA, 27 bp; single-stranded, linear
  The letter "N" stands for the stem II region of a HH ribozyme.
gaaucagccugaugangaaaaaacccu

SEQ ID NO: 992 - DNA, 27 bp; single-stranded, linear
  The letter "N" stands for the stem II region of a HH ribozyme.
caagccugcugaugangaaaucagcaa

SEQ ID NO: 993 - DNA, 27 bp; single-stranded, linear
  The letter "N" stands for the stem II region of a HH ribozyme.
ccaagccucugaugangaaaaucagca

SEQ ID NO: 994 - DNA, 27 bp; single-stranded, linear
  The letter "N" stands for the stem II region of a HH ribozyme.
uucaggcccugaugangaaagccugaa

SEQ ID NO: 995 - DNA, 27 bp; single-stranded, linear
  The letter "N" stands for the stem II region of a HH ribozyme.
aaggcaugcugaugangaaagguccgu

SEQ ID NO: 996 - DNA, 27 bp; single-stranded, linear
  The letter "N" stands for the stem II region of a HH ribozyme.
gguucucacugaugangaaaggcaugg

SEQ ID NO: 997 - DNA, 27 bp; single-stranded, linear
  The letter "N" stands for the stem II region of a HH ribozyme.
agguucuccugaugangaaaaggcaug

SEQ ID NO: 998 - DNA, 27 bp; single-stranded, linear
  The letter "N" stands for the stem II region of a HH ribozyme.
augauuuccugaugangaaagguucuc

SEQ ID NO: 999 - DNA, 27 bp; single-stranded, linear
  The letter "N" stands for the stem II region of a HH ribozyme.
ccgcguaucugaugangaaauuucuag

SEQ ID NO: 1000 - DNA, 27 bp; single-stranded, linear
  The letter "N" stands for the stem II region of a HH ribozyme.
cugccgcgcugaugangaaaugauuuc

SEQ ID NO: 1001 - DNA, 27 bp; single-stranded, linear
  The letter "N" stands for the stem II region of a HH ribozyme.
agaaaacucugaugangaaaccauguu

SEQ ID NO: 1002 - DNA, 27 bp; single-stranded, linear
  The letter "N" stands for the stem II region of a HH ribozyme.
caagagaacugaugangaaacugacca

SEQ ID NO: 1003 - DNA, 27 bp; single-stranded, linear
  The letter "N" stands for the stem II region of a HH ribozyme.
gcaagagacugaugangaaaacugacc

SEQ ID NO: 1004 - DNA, 27 bp; single-stranded, linear
  The letter "N" stands for the stem II region of a HH ribozyme.
ugcaagagcugaugangaaaaacugac

SEQ ID NO: 1005 - DNA, 27 bp; single-stranded, linear
  The letter "N" stands for the stem II region of a HH ribozyme.
cugcaagacugaugangaaaaaacuga

SEQ ID NO: 1006 - DNA, 27 bp; single-stranded, linear
  The letter "N" stands for the stem II region of a HH ribozyme.
gacugcaacugaugangaaagaaaacu

SEQ ID NO: 1007 - DNA, 27 bp; single-stranded, linear
  The letter "N" stands for the stem II region of a HH ribozyme.
acgacugccugaugangaaagagaaaa

SEQ ID NO: 1008 - DNA, 27 bp; single-stranded, linear
  The letter "N" stands for the stem II region of a HH ribozyme.
aggcugaccugaugangaaacugcaag

SEQ ID NO: 1009 - DNA, 27 bp; single-stranded, linear
  The letter "N" stands for the stem II region of a HH ribozyme.
uucaggcucugaugangaaacgacugc

SEQ ID NO: 1010 - DNA, 27 bp; single-stranded, linear
  The letter "N" stands for the stem II region of a HH ribozyme.
aaggaugucugaugangaaauguucag

SEQ ID NO: 1011 - DNA, 27 bp; single-stranded, linear
  The letter "N" stands for the stem II region of a HH ribozyme.
aucccaagcugaugangaaauguuaug

SEQ ID NO: 1012 - DNA, 27 bp; single-stranded, linear
  The letter "N" stands for the stem II region of a HH ribozyme.
guaauccccugaugangaaaggauguu

SEQ ID NO: 1013 - DNA, 27 bp; single-stranded, linear
  The letter "N" stands for the stem II region of a HH ribozyme.
gggagcgucugaugangaaaucccaag

SEQ ID NO: 1014 - DNA, 27 bp; single-stranded, linear
  The letter "N" stands for the stem II region of a HH ribozyme.
agggagcgcugaugangaaaaucccaa

SEQ ID NO: 1015 - DNA, 27 bp; single-stranded, linear
  The letter "N" stands for the stem II region of a HH ribozyme.
ccuugaggcugaugangaaagcguaau

SEQ ID NO: 1016 - DNA, 27 bp; single-stranded, linear
  The letter "N" stands for the stem II region of a HH ribozyme.
aucuccuucugaugangaaagggagcg

SEQ ID NO: 1017 - DNA, 27 bp; single-stranded, linear
  The letter "N" stands for the stem II region of a HH ribozyme.
ccaucacucugaugangaaaucuccuu

SEQ ID NO: 1018 - DNA, 27 bp; single-stranded, linear
  The letter "N" stands for the stem II region of a HH ribozyme.
ccugaaaucugaugangaaaucacauc

SEQ ID NO: 1019 - DNA, 27 bp; single-stranded, linear
  The letter "N" stands for the stem II region of a HH ribozyme.
uuuccugacugaugangaaauuaucac

SEQ ID NO: 1020 - DNA, 27 bp; single-stranded, linear
  The letter "N" stands for the stem II region of a HH ribozyme.
guuuccugcugaugangaaaauuauca

SEQ ID NO: 1021 - DNA, 27 bp; single-stranded, linear
  The letter "N" stands for the stem II region of a HH ribozyme.
uguuuccucugaugangaaaaauuauc

SEQ ID NO: 1022 - DNA, 27 bp; single-stranded, linear
  The letter "N" stands for the stem II region of a HH ribozyme.
auagcacacugaugangaaauuuuugu

SEQ ID NO: 1023 - DNA, 27 bp; single-stranded, linear
  The letter "N" stands for the stem II region of a HH ribozyme.
cauagcaccugaugangaaaauuuuug

SEQ ID NO: 1024 - DNA, 27 bp; single-stranded, linear
  The letter "N" stands for the stem II region of a HH ribozyme.
uauuugcacugaugangaaagcacaaa

SEQ ID NO: 1025 - DNA, 27 bp; single-stranded, linear
  The letter "N" stands for the stem II region of a HH ribozyme.
guuuauugcugaugangaaauuugcau

SEQ ID NO: 1026 - DNA, 27 bp; single-stranded, linear
  The letter "N" stands for the stem II region of a HH ribozyme.
uuccaguucugaugangaaauuguauu

SEQ ID NO: 1027 - DNA, 27 bp; single-stranded, linear
  The letter "N" stands for the stem II region of a HH ribozyme.
aggucccacugaugangaaacaguuuu

SEQ ID NO: 1028 - DNA, 27 bp; single-stranded, linear
  The letter "N" stands for the stem II region of a HH ribozyme.
gagguccccugaugangaaaacaguuu

SEQ ID NO: 1029 - DNA, 27 bp; single-stranded, linear
  The letter "N" stands for the stem II region of a HH ribozyme.
ucugaccgcugaugangaaagguccca

SEQ ID NO: 1030 - DNA, 27 bp; single-stranded, linear
  The letter "N" stands for the stem II region of a HH ribozyme.
gguuuucucugaugangaaaccggagg

SEQ ID NO: 1031 - DNA, 27 bp; single-stranded, linear
  The letter "N" stands for the stem II region of a HH ribozyme.
uugcuuaucugaugangaaauuuuggu

SEQ ID NO: 1032 - DNA, 27 bp; single-stranded, linear
  The letter "N" stands for the stem II region of a HH ribozyme.
guugcuuacugaugangaaaauuuugg

SEQ ID NO: 1033 - DNA, 27 bp; single-stranded, linear
  The letter "N" stands for the stem II region of a HH ribozyme.
cuguugcucugaugangaaauaauuuu

SEQ ID NO: 1034 - DNA, 27 bp; single-stranded, linear
  The letter "N" stands for the stem II region of a HH ribozyme.
gcauggcacugaugangaaaccuggcc

SEQ ID NO: 1035 - DNA, 27 bp; single-stranded, linear
  The letter "N" stands for the stem II region of a HH ribozyme.
gggagcaccugaugangaaaggcaugg

SEQ ID NO: 1036 - DNA, 27 bp; single-stranded, linear
  The letter "N" stands for the stem II region of a HH ribozyme.
ccucggggcugaugangaaagcacaag

SEQ ID NO: 1037 - DNA, 27 bp; single-stranded, linear
  The letter "N" stands for the stem II region of a HH ribozyme.
cggcaagacugaugangaaacgcaguc

SEQ ID NO: 1038 - DNA, 27 bp; single-stranded, linear
  The letter "N" stands for the stem II region of a HH ribozyme.
uccggcaacugaugangaaagacgcag

SEQ ID NO: 1039 - DNA, 27 bp; single-stranded, linear
  The letter "N" stands for the stem II region of a HH ribozyme.
auuccggccugaugangaaagagacgc

SEQ ID NO: 1040 - DNA, 27 bp; single-stranded, linear
  The letter "N" stands for the stem II region of a HH ribozyme.
ccucggcucugaugangaaacauuccg

SEQ ID NO: 1041 - DNA, 27 bp; single-stranded, linear
  The letter "N" stands for the stem II region of a HH ribozyme.
cccuccagcugaugangaaagcuugca

SEQ ID NO: 1042 - DNA, 27 bp; single-stranded, linear
  The letter "N" stands for the stem II region of a HH ribozyme.
acccuccacugaugangaaaagcuugc

SEQ ID NO: 1043 - DNA, 27 bp; single-stranded, linear
  The letter "N" stands for the stem II region of a HH ribozyme.
ucuccacacugaugangaaacucccuu

SEQ ID NO: 1044 - DNA, 27 bp; single-stranded, linear
  The letter "N" stands for the stem II region of a HH ribozyme.
uucuccaccugaugangaaaacucccu

SEQ ID NO: 1045 - DNA, 27 bp; single-stranded, linear
  The letter "N" stands for the stem II region of a HH ribozyme.
ugcacucacugaugangaaaguucucc

SEQ ID NO: 1046 - DNA, 27 bp; single-stranded, linear
  The letter "N" stands for the stem II region of a HH ribozyme.
uggcacugcugaugangaaaugcacuc

SEQ ID NO: 1047 - DNA, 27 bp; single-stranded, linear
  The letter "N" stands for the stem II region of a HH ribozyme.
cauggccucugaugangaaaggcaggc

SEQ ID NO: 1048 - DNA, 27 bp; single-stranded, linear
  The letter "N" stands for the stem II region of a HH ribozyme.
gugcaggucugaugangaaauguucau

SEQ ID NO: 1049 - DNA, 27 bp; single-stranded, linear
  The letter "N" stands for the stem II region of a HH ribozyme.
acacuggacugaugangaaacaguugu

SEQ ID NO: 1050 - DNA, 27 bp; single-stranded, linear
  The letter "N" stands for the stem II region of a HH ribozyme.
gcacacugcugaugangaaauacaguu

SEQ ID NO: 1051 - DNA, 27 bp; single-stranded, linear
  The letter "N" stands for the stem II region of a HH ribozyme.
cgucaaugcugaugangaaagugggca

SEQ ID NO: 1052 - DNA, 27 bp; single-stranded, linear
  The letter "N" stands for the stem II region of a HH ribozyme.
gggccguccugaugangaaauguagug

SEQ ID NO: 1053 - DNA, 27 bp; single-stranded, linear
  The letter "N" stands for the stem II region of a HH ribozyme.
caggucuucugaugangaaacgcagug

SEQ ID NO: 1054 - DNA, 27 bp; single-stranded, linear
  The letter "N" stands for the stem II region of a HH ribozyme.
ucucccaucugaugangaaacuccugc

SEQ ID NO: 1055 - DNA, 27 bp; single-stranded, linear
  The letter "N" stands for the stem II region of a HH ribozyme.
uacuuccacugaugangaaaccagggu

SEQ ID NO: 1056 - DNA, 27 bp; single-stranded, linear
  The letter "N" stands for the stem II region of a HH ribozyme.
cgucugcgcugaugangaaacuuccag

SEQ ID NO: 1057 - DNA, 27 bp; single-stranded, linear
  The letter "N" stands for the stem II region of a HH ribozyme.
gcaguuugcugaugangaaauggcaca

SEQ ID NO: 1058 - DNA, 27 bp; single-stranded, linear
  The letter "N" stands for the stem II region of a HH ribozyme.
ugcauccgcugaugangaaaggugcag

SEQ ID NO: 1059 - DNA, 27 bp; single-stranded, linear
  The letter "N" stands for the stem II region of a HH ribozyme.
gccuucaacugaugangaaaccuggcc

SEQ ID NO: 1060 - DNA, 27 bp; single-stranded, linear
  The letter "N" stands for the stem II region of a HH ribozyme.
cagccuuccugaugangaaagaccugg

SEQ ID NO: 1061 - DNA, 27 bp; single-stranded, linear
  The letter "N" stands for the stem II region of a HH ribozyme.
auucguugcugaugangaaacagccuu

SEQ ID NO: 1062 - DNA, 27 bp; single-stranded, linear
  The letter "N" stands for the stem II region of a HH ribozyme.
cgggaucucugaugangaaaggcccau

SEQ ID NO: 1063 - DNA, 27 bp; single-stranded, linear
  The letter "N" stands for the stem II region of a HH ribozyme.
auggacggcugaugangaaaucuuagg

SEQ ID NO: 1064 - DNA, 27 bp; single-stranded, linear
  The letter "N" stands for the stem II region of a HH ribozyme.
uggcgaugcugaugangaaacgggauc

SEQ ID NO: 1065 - DNA, 27 bp; single-stranded, linear
  The letter "N" stands for the stem II region of a HH ribozyme.
ccaguggccugaugangaaauggacgg

SEQ ID NO: 1066 - DNA, 27 bp; single-stranded, linear
  The letter "N" stands for the stem II region of a HH ribozyme.
agcaagagcugaugangaaagggcccc

SEQ ID NO: 1067 - DNA, 27 bp; single-stranded, linear
  The letter "N" stands for the stem II region of a HH ribozyme.
agcagcaacugaugangaaaggagggc

SEQ ID NO: 1068 - DNA, 27 bp; single-stranded, linear
  The letter "N" stands for the stem II region of a HH ribozyme.
ccagcagccugaugangaaagaggagg

SEQ ID NO: 1069 - DNA, 27 bp; single-stranded, linear
  The letter "N" stands for the stem II region of a HH ribozyme.
aagaggcccugaugangaaauccccag

SEQ ID NO: 1070 - DNA, 27 bp; single-stranded, linear
  The letter "N" stands for the stem II region of a HH ribozyme.
cgcaugaacugaugangaaaggccgau

SEQ ID NO: 1071 - DNA, 27 bp; single-stranded, linear
  The letter "N" stands for the stem II region of a HH ribozyme.
uucgcaugcugaugangaaagaggccg

SEQ ID NO: 1072 - DNA, 27 bp; single-stranded, linear
  The letter "N" stands for the stem II region of a HH ribozyme.
cuucgcaucugaugangaaaagaggcc

SEQ ID NO: 1073 - DNA, 27 bp; single-stranded, linear
  The letter "N" stands for the stem II region of a HH ribozyme.
uuccgaaccugaugangaaauguggcg

SEQ ID NO: 1074 - DNA, 27 bp; single-stranded, linear
  The letter "N" stands for the stem II region of a HH ribozyme.
cgcuuccgcugaugangaaacgaugug

SEQ ID NO: 1075 - DNA, 27 bp; single-stranded, linear
  The letter "N" stands for the stem II region of a HH ribozyme.
gcgcuucccugaugangaaaacgaugu

SEQ ID NO: 1076 - DNA, 27 bp; single-stranded, linear
  The letter "N" stands for the stem II region of a HH ribozyme.
ggcuccaccugaugangaaagcucccu

SEQ ID NO: 1077 - DNA, 27 bp; single-stranded, linear
  The letter "N" stands for the stem II region of a HH ribozyme.
ggguguaacugaugangaaaggcucca

SEQ ID NO: 1078 - DNA, 27 bp; single-stranded, linear
  The letter "N" stands for the stem II region of a HH ribozyme.
cugggugucugaugangaaagaggcuc

SEQ ID NO: 1079 - DNA, 27 bp; single-stranded, linear
  The letter "N" stands for the stem II region of a HH ribozyme.
acugggugcugaugangaaaagaggcu

SEQ ID NO: 1080 - DNA, 27 bp; single-stranded, linear
  The letter "N" stands for the stem II region of a HH ribozyme.
uugguuggcugaugangaaagcuucuc

SEQ ID NO: 1081 - DNA, 27 bp; single-stranded, linear
  The letter "N" stands for the stem II region of a HH ribozyme.
ccucaagacugaugangaaagcuuggu

SEQ ID NO: 1082 - DNA, 27 bp; single-stranded, linear
  The letter "N" stands for the stem II region of a HH ribozyme.
auccucaacugaugangaaagagcuug

SEQ ID NO: 1083 - DNA, 27 bp; single-stranded, linear
  The letter "N" stands for the stem II region of a HH ribozyme.
agauccuccugaugangaaagagagcu

SEQ ID NO: 1084 - DNA, 27 bp; single-stranded, linear
  The letter "N" stands for the stem II region of a HH ribozyme.
uccuucaacugaugangaaauccucaa

SEQ ID NO: 1085 - DNA, 27 bp; single-stranded, linear
  The letter "N" stands for the stem II region of a HH ribozyme.
uuuccuuccugaugangaaagauccuc

SEQ ID NO: 1086 - DNA, 27 bp; single-stranded, linear
  The letter "N" stands for the stem II region of a HH ribozyme.
ucuuuuugcugaugangaaauucaguu

SEQ ID NO: 1087 - DNA, 27 bp; single-stranded, linear
  The letter "N" stands for the stem II region of a HH ribozyme.
aucuuuuucugaugangaaaauucagu

SEQ ID NO: 1088 - DNA, 27 bp; single-stranded, linear
  The letter "N" stands for the stem II region of a HH ribozyme.
agcacuuucugaugangaaaucuuuuu

SEQ ID NO: 1089 - DNA, 27 bp; single-stranded, linear
  The letter "N" stands for the stem II region of a HH ribozyme.
acgcaccgcugaugangaaagcccagc

SEQ ID NO: 1090 - DNA, 27 bp; single-stranded, linear
  The letter "N" stands for the stem II region of a HH ribozyme.
ccgugccgcugaugangaaacgcaccg

SEQ ID NO: 1091 - DNA, 27 bp; single-stranded, linear
  The letter "N" stands for the stem II region of a HH ribozyme.
accgugcccugaugangaaaacgcacc

SEQ ID NO: 1092 - DNA, 27 bp; single-stranded, linear
  The letter "N" stands for the stem II region of a HH ribozyme.
gucccuuacugaugangaaacaccgug

SEQ ID NO: 1093 - DNA, 27 bp; single-stranded, linear
  The letter "N" stands for the stem II region of a HH ribozyme.
gagucccucugaugangaaauacaccg

SEQ ID NO: 1094 - DNA, 27 bp; single-stranded, linear
  The letter "N" stands for the stem II region of a HH ribozyme.
gggauccacugaugangaaagucccuu

SEQ ID NO: 1095 - DNA, 27 bp; single-stranded, linear
  The letter "N" stands for the stem II region of a HH ribozyme.
ccuucuggcugaugangaaauccagag

SEQ ID NO: 1096 - DNA, 27 bp; single-stranded, linear
  The letter "N" stands for the stem II region of a HH ribozyme.
ggaauuuucugaugangaaacuuucuc

SEQ ID NO: 1097 - DNA, 27 bp; single-stranded, linear
  The letter "N" stands for the stem II region of a HH ribozyme.
gggaauuucugaugangaaaacuuucu

SEQ ID NO: 1098 - DNA, 27 bp; single-stranded, linear
  The letter "N" stands for the stem II region of a HH ribozyme.
gcgacgggcugaugangaaauuuuaac

SEQ ID NO: 1099 - DNA, 27 bp; single-stranded, linear
  The letter "N" stands for the stem II region of a HH ribozyme.
agcgacggcugaugangaaaauuuuaa

SEQ ID NO: 1100 - DNA, 27 bp; single-stranded, linear
  The letter "N" stands for the stem II region of a HH ribozyme.
uugauagccugaugangaaacgggaau

SEQ ID NO: 1101 - DNA, 27 bp; single-stranded, linear
  The letter "N" stands for the stem II region of a HH ribozyme.
uuccuugacugaugangaaagcgacgg

SEQ ID NO: 1102 - DNA, 27 bp; single-stranded, linear
  The letter "N" stands for the stem II region of a HH ribozyme.
aauuccuucugaugangaaauagcgac

SEQ ID NO: 1103 - DNA, 27 bp; single-stranded, linear
  The letter "N" stands for the stem II region of a HH ribozyme.
cuucucuucugaugangaaauuccuug

SEQ ID NO: 1104 - DNA, 27 bp; single-stranded, linear
  The letter "N" stands for the stem II region of a HH ribozyme.
gcuucucucugaugangaaaauuccuu

SEQ ID NO: 1105 - DNA, 27 bp; single-stranded, linear
  The letter "N" stands for the stem II region of a HH ribozyme.
cuuucggacugaugangaaauguugcu

SEQ ID NO: 1106 - DNA, 27 bp; single-stranded, linear
  The letter "N" stands for the stem II region of a HH ribozyme.
ggcuuucgcugaugangaaagauguug

SEQ ID NO: 1107 - DNA, 27 bp; single-stranded, linear
  The letter "N" stands for the stem II region of a HH ribozyme.
ucaucgagcugaugangaaauuuccuu

SEQ ID NO: 1108 - DNA, 27 bp; single-stranded, linear
  The letter "N" stands for the stem II region of a HH ribozyme.
gcuucauccugaugangaaaggauuuc

SEQ ID NO: 1109 - DNA, 27 bp; single-stranded, linear
  The letter "N" stands for the stem II region of a HH ribozyme.
ccaucacgcugaugangaaaggcuuca

SEQ ID NO: 1110 - DNA, 27 bp; single-stranded, linear
  The letter "N" stands for the stem II region of a HH ribozyme.
gugaggcacugaugangaaaugcccag

SEQ ID NO: 1111 - DNA, 27 bp; single-stranded, linear
  The letter "N" stands for the stem II region of a HH ribozyme.
guggaggucugaugangaaaggcagau

SEQ ID NO: 1112 - DNA, 27 bp; single-stranded, linear
  The letter "N" stands for the stem II region of a HH ribozyme.
gcacggugcugaugangaaaggugagg

SEQ ID NO: 1113 - DNA, 27 bp; single-stranded, linear
  The letter "N" stands for the stem II region of a HH ribozyme.
ugcgugaucugaugangaaaguugcac

SEQ ID NO: 1114 - DNA, 27 bp; single-stranded, linear
  The letter "N" stands for the stem II region of a HH ribozyme.
agcugcgucugaugangaaaugaguug

SEQ ID NO: 1115 - DNA, 27 bp; single-stranded, linear
  The letter "N" stands for the stem II region of a HH ribozyme.
aagggcaucugaugangaaagcugcgu

SEQ ID NO: 1116 - DNA, 27 bp; single-stranded, linear
  The letter "N" stands for the stem II region of a HH ribozyme.
ggcagccgcugaugangaaagggcaug

SEQ ID NO: 1117 - DNA, 27 bp; single-stranded, linear
  The letter "N" stands for the stem II region of a HH ribozyme.
aggcagcccugaugangaaaagggcau

SEQ ID NO: 1118 - DNA, 27 bp; single-stranded, linear
  The letter "N" stands for the stem II region of a HH ribozyme.
uaguccagcugaugangaaaggcagcc

SEQ ID NO: 1119 - DNA, 27 bp; single-stranded, linear
  The letter "N" stands for the stem II region of a HH ribozyme.
cccggacacugaugangaaaguccagg

SEQ ID NO: 1120 - DNA, 27 bp; single-stranded, linear
  The letter "N" stands for the stem II region of a HH ribozyme.
uguucccgcugaugangaaacauaguc

SEQ ID NO: 1121 - DNA, 27 bp; single-stranded, linear
  The letter "N" stands for the stem II region of a HH ribozyme.
ggagccaacugaugangaaauugucuu

SEQ ID NO: 1122 - DNA, 27 bp; single-stranded, linear
  The letter "N" stands for the stem II region of a HH ribozyme.
ugggagcccugaugangaaauauuguc

SEQ ID NO: 1123 - DNA, 27 bp; single-stranded, linear
  The letter "N" stands for the stem II region of a HH ribozyme.
gguacuggcugaugangaaagccaaua

SEQ ID NO: 1124 - DNA, 27 bp; single-stranded, linear
  The letter "N" stands for the stem II region of a HH ribozyme.
ugagcaggcugaugangaaacugggag

SEQ ID NO: 1125 - DNA, 27 bp; single-stranded, linear
  The letter "N" stands for the stem II region of a HH ribozyme.
caccaguucugaugangaaagcaggua

SEQ ID NO: 1126 - DNA, 27 bp; single-stranded, linear
  The letter "N" stands for the stem II region of a HH ribozyme.
cccuuugccugaugangaaaucugcac

SEQ ID NO: 1127 - DNA, 27 bp; single-stranded, linear
  The letter "N" stands for the stem II region of a HH ribozyme.
ccuccaagcugaugangaaaguucaug

SEQ ID NO: 1128 - DNA, 27 bp; single-stranded, linear
  The letter "N" stands for the stem II region of a HH ribozyme.
gguccucccugaugangaaaguaguuc

SEQ ID NO: 1129 - DNA, 27 bp; single-stranded, linear
  The letter "N" stands for the stem II region of a HH ribozyme.
caccaagccugaugangaaacgguccu

SEQ ID NO: 1130 - DNA, 27 bp; single-stranded, linear
  The letter "N" stands for the stem II region of a HH ribozyme.
ggugcacccugaugangaaagcgacgg

SEQ ID NO: 1131 - DNA, 27 bp; single-stranded, linear
  The letter "N" stands for the stem II region of a HH ribozyme.
uucaccagcugaugangaaacguuccu

SEQ ID NO: 1132 - DNA, 27 bp; single-stranded, linear
  The letter "N" stands for the stem II region of a HH ribozyme.
gugaucuucugaugangaaacaugcug

SEQ ID NO: 1133 - DNA, 27 bp; single-stranded, linear
  The letter "N" stands for the stem II region of a HH ribozyme.
aaaucugucugaugangaaaucuugac

SEQ ID NO: 1134 - DNA, 27 bp; single-stranded, linear
  The letter "N" stands for the stem II region of a HH ribozyme.
cagcccaacugaugangaaaucuguga

SEQ ID NO: 1135 - DNA, 27 bp; single-stranded, linear
  The letter "N" stands for the stem II region of a HH ribozyme.
ccagcccacugaugangaaaaucugug

SEQ ID NO: 1136 - DNA, 27 bp; single-stranded, linear
  The letter "N" stands for the stem II region of a HH ribozyme.
gccagccccugaugangaaaaaucugu

SEQ ID NO: 1137 - DNA, 27 bp; single-stranded, linear
  The letter "N" stands for the stem II region of a HH ribozyme.
cugcauggcugaugangaaauucuuuc

SEQ ID NO: 1138 - DNA, 27 bp; single-stranded, linear
  The letter "N" stands for the stem II region of a HH ribozyme.
ccacuugacugaugangaaaggcacuu

SEQ ID NO: 1139 - DNA, 27 bp; single-stranded, linear
  The letter "N" stands for the stem II region of a HH ribozyme.
auccacuucugaugangaaauaggcac

SEQ ID NO: 1140 - DNA, 27 bp; single-stranded, linear
  The letter "N" stands for the stem II region of a HH ribozyme.
uugauucccugaugangaaaugccauc

SEQ ID NO: 1141 - DNA, 27 bp; single-stranded, linear
  The letter "N" stands for the stem II region of a HH ribozyme.
guaaaauucugaugangaaauuccaau

SEQ ID NO: 1142 - DNA, 27 bp; single-stranded, linear
  The letter "N" stands for the stem II region of a HH ribozyme.
cuguguaacugaugangaaauugauuc

SEQ ID NO: 1143 - DNA, 27 bp; single-stranded, linear
  The letter "N" stands for the stem II region of a HH ribozyme.
ucuguguacugaugangaaaauugauu

SEQ ID NO: 1144 - DNA, 27 bp; single-stranded, linear
  The letter "N" stands for the stem II region of a HH ribozyme.
uucugugucugaugangaaaaauugau

SEQ ID NO: 1145 - DNA, 27 bp; single-stranded, linear
  The letter "N" stands for the stem II region of a HH ribozyme.
auucugugcugaugangaaaaaauuga

SEQ ID NO: 1146 - DNA, 27 bp; single-stranded, linear
  The letter "N" stands for the stem II region of a HH ribozyme.
uggguauacugaugangaaauucugug

SEQ ID NO: 1147 - DNA, 27 bp; single-stranded, linear
  The letter "N" stands for the stem II region of a HH ribozyme.
gguggguacugaugangaaagauucug

SEQ ID NO: 1148 - DNA, 27 bp; single-stranded, linear
  The letter "N" stands for the stem II region of a HH ribozyme.
cuggugggcugaugangaaauagauuc

SEQ ID NO: 1149 - DNA, 27 bp; single-stranded, linear
  The letter "N" stands for the stem II region of a HH ribozyme.
uagcuccacugaugangaaacaucacu

SEQ ID NO: 1150 - DNA, 27 bp; single-stranded, linear
  The letter "N" stands for the stem II region of a HH ribozyme.
ucaccccgcugaugangaaagcuccag

SEQ ID NO: 1151 - DNA, 27 bp; single-stranded, linear
  The letter "N" stands for the stem II region of a HH ribozyme.
aacucccacugaugangaaacggucac

SEQ ID NO: 1152 - DNA, 27 bp; single-stranded, linear
  The letter "N" stands for the stem II region of a HH ribozyme.
caacuccccugaugangaaaacgguca

SEQ ID NO: 1153 - DNA, 27 bp; single-stranded, linear
  The letter "N" stands for the stem II region of a HH ribozyme.
aggucauccugaugangaaacucccaa

SEQ ID NO: 1154 - DNA, 27 bp; single-stranded, linear
  The letter "N" stands for the stem II region of a HH ribozyme.
uggauccacugaugangaaaggucauc

SEQ ID NO: 1155 - DNA, 27 bp; single-stranded, linear
  The letter "N" stands for the stem II region of a HH ribozyme.
uuggaucccugaugangaaaaggucau

SEQ ID NO: 1156 - DNA, 27 bp; single-stranded, linear
  The letter "N" stands for the stem II region of a HH ribozyme.
auggcuugcugaugangaaauccaaag

SEQ ID NO: 1157 - DNA, 27 bp; single-stranded, linear
  The letter "N" stands for the stem II region of a HH ribozyme.
uuccgucacugaugangaaauggcuug

SEQ ID NO: 1158 - DNA, 27 bp; single-stranded, linear
  The letter "N" stands for the stem II region of a HH ribozyme.
cuggcaggcugaugangaaauuccguc

SEQ ID NO: 1159 - DNA, 27 bp; single-stranded, linear
  The letter "N" stands for the stem II region of a HH ribozyme.
auggaggacugaugangaaaucucgcu

SEQ ID NO: 1160 - DNA, 27 bp; single-stranded, linear
  The letter "N" stands for the stem II region of a HH ribozyme.
ggauggagcugaugangaaagaucucg

SEQ ID NO: 1161 - DNA, 27 bp; single-stranded, linear
  The letter "N" stands for the stem II region of a HH ribozyme.
ccaggaugcugaugangaaaggagauc

SEQ ID NO: 1162 - DNA, 27 bp; single-stranded, linear
  The letter "N" stands for the stem II region of a HH ribozyme.
uucuccagcugaugangaaauggagga

SEQ ID NO: 1163 - DNA, 27 bp; single-stranded, linear
  The letter "N" stands for the stem II region of a HH ribozyme.
ggcugaggcugaugangaaaggcguuc

SEQ ID NO: 1164 - DNA, 27 bp; single-stranded, linear
  The letter "N" stands for the stem II region of a HH ribozyme.
ggguggcucugaugangaaagggaggc

SEQ ID NO: 1165 - DNA, 27 bp; single-stranded, linear
  The letter "N" stands for the stem II region of a HH ribozyme.
augguacacugaugangaaaugggugg

SEQ ID NO: 1166 - DNA, 27 bp; single-stranded, linear
  The letter "N" stands for the stem II region of a HH ribozyme.
aucgauggcugaugangaaacauaugg

SEQ ID NO: 1167 - DNA, 27 bp; single-stranded, linear
  The letter "N" stands for the stem II region of a HH ribozyme.
uagacauccugaugangaaaugguaca

SEQ ID NO: 1168 - DNA, 27 bp; single-stranded, linear
  The letter "N" stands for the stem II region of a HH ribozyme.
aucauguacugaugangaaacaucgau

SEQ ID NO: 1169 - DNA, 27 bp; single-stranded, linear
  The letter "N" stands for the stem II region of a HH ribozyme.
ugaucaugcugaugangaaagacaucg

SEQ ID NO: 1170 - DNA, 27 bp; single-stranded, linear
  The letter "N" stands for the stem II region of a HH ribozyme.
uugaccaucugaugangaaaucaugua

SEQ ID NO: 1171 - DNA, 27 bp; single-stranded, linear
  The letter "N" stands for the stem II region of a HH ribozyme.
cagcacuucugaugangaaaccaugau

SEQ ID NO: 1172 - DNA, 27 bp; single-stranded, linear
  The letter "N" stands for the stem II region of a HH ribozyme.
ucugcguccugaugangaaaucaucca

SEQ ID NO: 1173 - DNA, 27 bp; single-stranded, linear
  The letter "N" stands for the stem II region of a HH ribozyme.
ugggcgaccugaugangaaaucugcgu

SEQ ID NO: 1174 - DNA, 27 bp; single-stranded, linear
  The letter "N" stands for the stem II region of a HH ribozyme.
cuuugggccugaugangaaacuaucug

SEQ ID NO: 1175 - DNA, 27 bp; single-stranded, linear
  The letter "N" stands for the stem II region of a HH ribozyme.
acucacggcugaugangaaacuuuggg

SEQ ID NO: 1176 - DNA, 27 bp; single-stranded, linear
  The letter "N" stands for the stem II region of a HH ribozyme.
aacucacgcugaugangaaaacuuugg

SEQ ID NO: 1177 - DNA, 27 bp; single-stranded, linear
  The letter "N" stands for the stem II region of a HH ribozyme.
cgaugauccugaugangaaacucacgg

SEQ ID NO: 1178 - DNA, 27 bp; single-stranded, linear
  The letter "N" stands for the stem II region of a HH ribozyme.
aauucgaucugaugangaaaucaacuc

SEQ ID NO: 1179 - DNA, 27 bp; single-stranded, linear
  The letter "N" stands for the stem II region of a HH ribozyme.
gagaauuccugaugangaaaugaucaa

SEQ ID NO: 1180 - DNA, 27 bp; single-stranded, linear
  The letter "N" stands for the stem II region of a HH ribozyme.
uuuuggagcugaugangaaauucgaug

SEQ ID NO: 1181 - DNA, 27 bp; single-stranded, linear
  The letter "N" stands for the stem II region of a HH ribozyme.
auuuuggacugaugangaaaauucgau

SEQ ID NO: 1182 - DNA, 27 bp; single-stranded, linear
  The letter "N" stands for the stem II region of a HH ribozyme.
ccauuuugcugaugangaaagaauucg

SEQ ID NO: 1183 - DNA, 27 bp; single-stranded, linear
  The letter "N" stands for the stem II region of a HH ribozyme.
ugacaaggcugaugangaaagcgcugg

SEQ ID NO: 1184 - DNA, 27 bp; single-stranded, linear
  The letter "N" stands for the stem II region of a HH ribozyme.
ugaaugaccugaugangaaagguagcg

SEQ ID NO: 1185 - DNA, 27 bp; single-stranded, linear
  The letter "N" stands for the stem II region of a HH ribozyme.
cccugaaucugaugangaaacaaggua

SEQ ID NO: 1186 - DNA, 27 bp; single-stranded, linear
  The letter "N" stands for the stem II region of a HH ribozyme.
ucccccugcugaugangaaaugacaag

SEQ ID NO: 1187 - DNA, 27 bp; single-stranded, linear
  The letter "N" stands for the stem II region of a HH ribozyme.
aucccccucugaugangaaaaugacaa

SEQ ID NO: 1188 - DNA, 27 bp; single-stranded, linear
  The letter "N" stands for the stem II region of a HH ribozyme.
acuuggcacugaugangaaaugcauuc

SEQ ID NO: 1189 - DNA, 27 bp; single-stranded, linear
  The letter "N" stands for the stem II region of a HH ribozyme.
gacuuggccugaugangaaaaugcauu

SEQ ID NO: 1190 - DNA, 27 bp; single-stranded, linear
  The letter "N" stands for the stem II region of a HH ribozyme.
gucuguagcugaugangaaacuuggca

SEQ ID NO: 1191 - DNA, 27 bp; single-stranded, linear
  The letter "N" stands for the stem II region of a HH ribozyme.
ggagucugcugaugangaaaggacuug

SEQ ID NO: 1192 - DNA, 27 bp; single-stranded, linear
  The letter "N" stands for the stem II region of a HH ribozyme.
agaaguugcugaugangaaagucugua

SEQ ID NO: 1193 - DNA, 27 bp; single-stranded, linear
  The letter "N" stands for the stem II region of a HH ribozyme.
cacgguagcugaugangaaaguuggag

SEQ ID NO: 1194 - DNA, 27 bp; single-stranded, linear
  The letter "N" stands for the stem II region of a HH ribozyme.
gcacgguacugaugangaaaaguugga

SEQ ID NO: 1195 - DNA, 27 bp; single-stranded, linear
  The letter "N" stands for the stem II region of a HH ribozyme.
gggcacggcugaugangaaagaaguug

SEQ ID NO: 1196 - DNA, 27 bp; single-stranded, linear
  The letter "N" stands for the stem II region of a HH ribozyme.
ggaugaggcugaugangaaacucgucg

SEQ ID NO: 1197 - DNA, 27 bp; single-stranded, linear
  The letter "N" stands for the stem II region of a HH ribozyme.
ugugggaucugaugangaaagguacuc

SEQ ID NO: 1198 - DNA, 27 bp; single-stranded, linear
  The letter "N" stands for the stem II region of a HH ribozyme.
ugcuguggcugaugangaaaugaggua

SEQ ID NO: 1199 - DNA, 27 bp; single-stranded, linear
  The letter "N" stands for the stem II region of a HH ribozyme.
ugcugaagcugaugangaaagcccugc

SEQ ID NO: 1200 - DNA, 27 bp; single-stranded, linear
  The letter "N" stands for the stem II region of a HH ribozyme.
cugcugaacugaugangaaaagcccug

SEQ ID NO: 1201 - DNA, 27 bp; single-stranded, linear
  The letter "N" stands for the stem II region of a HH ribozyme.
ggcugcugcugaugangaaagaagccc

SEQ ID NO: 1202 - DNA, 27 bp; single-stranded, linear
  The letter "N" stands for the stem II region of a HH ribozyme.
gggcugcucugaugangaaaagaagcc

SEQ ID NO: 1203 - DNA, 27 bp; single-stranded, linear
  The letter "N" stands for the stem II region of a HH ribozyme.
gugacgugcugaugangaaaggggcug

SEQ ID NO: 1204 - DNA, 27 bp; single-stranded, linear
  The letter "N" stands for the stem II region of a HH ribozyme.
gaguccgucugaugangaaacguggag

SEQ ID NO: 1205 - DNA, 27 bp; single-stranded, linear
  The letter "N" stands for the stem II region of a HH ribozyme.
caggagggcugaugangaaaguccgug

SEQ ID NO: 1206 - DNA, 27 bp; single-stranded, linear
  The letter "N" stands for the stem II region of a HH ribozyme.
gagcucagcugaugangaaaggggagu

SEQ ID NO: 1207 - DNA, 27 bp; single-stranded, linear
  The letter "N" stands for the stem II region of a HH ribozyme.
cacucagacugaugangaaagcucagg

SEQ ID NO: 1208 - DNA, 27 bp; single-stranded, linear
  The letter "N" stands for the stem II region of a HH ribozyme.
ugcacucacugaugangaaagagcuca

SEQ ID NO: 1209 - DNA, 27 bp; single-stranded, linear
  The letter "N" stands for the stem II region of a HH ribozyme.
cacgguggcugaugangaaauuguugc

SEQ ID NO: 1210 - DNA, 27 bp; single-stranded, linear
  The letter "N" stands for the stem II region of a HH ribozyme.
ccacggugcugaugangaaaauuguug

SEQ ID NO: 1211 - DNA, 27 bp; single-stranded, linear
  The letter "N" stands for the stem II region of a HH ribozyme.
aucaaugccugaugangaaagccacgg

SEQ ID NO: 1212 - DNA, 27 bp; single-stranded, linear
  The letter "N" stands for the stem II region of a HH ribozyme.
uuucuauccugaugangaaaugcaagc

SEQ ID NO: 1213 - DNA, 27 bp; single-stranded, linear
  The letter "N" stands for the stem II region of a HH ribozyme.
cccauuuccugaugangaaaucaaugc

SEQ ID NO: 1214 - DNA, 27 bp; single-stranded, linear
  The letter "N" stands for the stem II region of a HH ribozyme.
cuugauggcugaugangaaacagcuuu

SEQ ID NO: 1215 - DNA, 27 bp; single-stranded, linear
  The letter "N" stands for the stem II region of a HH ribozyme.
ucuuccuucugaugangaaaugggaca

SEQ ID NO: 1216 - DNA, 27 bp; single-stranded, linear
  The letter "N" stands for the stem II region of a HH ribozyme.
gcugcaagcugaugangaaagcugucu

SEQ ID NO: 1217 - DNA, 27 bp; single-stranded, linear
  The letter "N" stands for the stem II region of a HH ribozyme.
cgcugcaacugaugangaaaagcuguc

SEQ ID NO: 1218 - DNA, 27 bp; single-stranded, linear
  The letter "N" stands for the stem II region of a HH ribozyme.
aucgcugccugaugangaaagaagcug

SEQ ID NO: 1219 - DNA, 27 bp; single-stranded, linear
  The letter "N" stands for the stem II region of a HH ribozyme.
cugagcugcugaugangaaaucgcugc

SEQ ID NO: 1220 - DNA, 27 bp; single-stranded, linear
  The letter "N" stands for the stem II region of a HH ribozyme.
uggggucucugaugangaaagcuguau

SEQ ID NO: 1221 - DNA, 27 bp; single-stranded, linear
  The letter "N" stands for the stem II region of a HH ribozyme.
ccucaguccugaugangaaaggcgccu

SEQ ID NO: 1222 - DNA, 27 bp; single-stranded, linear
  The letter "N" stands for the stem II region of a HH ribozyme.
gugucguccugaugangaaaugcuguc

SEQ ID NO: 1223 - DNA, 27 bp; single-stranded, linear
  The letter "N" stands for the stem II region of a HH ribozyme.
cugggaggcugaugangaaaggugucg

SEQ ID NO: 1224 - DNA, 27 bp; single-stranded, linear
  The letter "N" stands for the stem II region of a HH ribozyme.
acugggagcugaugangaaaagguguc

SEQ ID NO: 1225 - DNA, 27 bp; single-stranded, linear
  The letter "N" stands for the stem II region of a HH ribozyme.
ggcacuggcugaugangaaaggaaggu

SEQ ID NO: 1226 - DNA, 27 bp; single-stranded, linear
  The letter "N" stands for the stem II region of a HH ribozyme.
gguuuaugcugaugangaaauucaggc

SEQ ID NO: 1227 - DNA, 27 bp; single-stranded, linear
  The letter "N" stands for the stem II region of a HH ribozyme.
gacugguucugaugangaaauguauuc

SEQ ID NO: 1228 - DNA, 27 bp; single-stranded, linear
  The letter "N" stands for the stem II region of a HH ribozyme.
ugggaacgcugaugangaaacugguuu

SEQ ID NO: 1229 - DNA, 27 bp; single-stranded, linear
  The letter "N" stands for the stem II region of a HH ribozyme.
cuuuugggcugaugangaaacggacug

SEQ ID NO: 1230 - DNA, 27 bp; single-stranded, linear
  The letter "N" stands for the stem II region of a HH ribozyme.
ccuuuuggcugaugangaaaacggacu

SEQ ID NO: 1231 - DNA, 27 bp; single-stranded, linear
  The letter "N" stands for the stem II region of a HH ribozyme.
ucugcacacugaugangaaagccagcg

SEQ ID NO: 1232 - DNA, 27 bp; single-stranded, linear
  The letter "N" stands for the stem II region of a HH ribozyme.
auagacagcugaugangaaauucugca

SEQ ID NO: 1233 - DNA, 27 bp; single-stranded, linear
  The letter "N" stands for the stem II region of a HH ribozyme.
uugugauacugaugangaaacaggauu

SEQ ID NO: 1234 - DNA, 27 bp; single-stranded, linear
  The letter "N" stands for the stem II region of a HH ribozyme.
gauugugacugaugangaaagacagga

SEQ ID NO: 1235 - DNA, 27 bp; single-stranded, linear
  The letter "N" stands for the stem II region of a HH ribozyme.
cugauugucugaugangaaauagacag

SEQ ID NO: 1236 - DNA, 27 bp; single-stranded, linear
  The letter "N" stands for the stem II region of a HH ribozyme.
cagaggcucugaugangaaauugugau

SEQ ID NO: 1237 - DNA, 27 bp; single-stranded, linear
  The letter "N" stands for the stem II region of a HH ribozyme.
gggguucacugaugangaaaggcugau

SEQ ID NO: 1238 - DNA, 27 bp; single-stranded, linear
  The letter "N" stands for the stem II region of a HH ribozyme.
gguccuggcugaugangaaaguguggg

SEQ ID NO: 1239 - DNA, 27 bp; single-stranded, linear
  The letter "N" stands for the stem II region of a HH ribozyme.
uguugagacugaugangaaacucgggg

SEQ ID NO: 1240 - DNA, 27 bp; single-stranded, linear
  The letter "N" stands for the stem II region of a HH ribozyme.
aguguugacugaugangaaauacucgg

SEQ ID NO: 1241 - DNA, 27 bp; single-stranded, linear
  The letter "N" stands for the stem II region of a HH ribozyme.
acaguguucugaugangaaagauacuc

SEQ ID NO: 1242 - DNA, 27 bp; single-stranded, linear
  The letter "N" stands for the stem II region of a HH ribozyme.
gugggcugcugaugangaaacaguguu

SEQ ID NO: 1243 - DNA, 27 bp; single-stranded, linear
  The letter "N" stands for the stem II region of a HH ribozyme.
gugcuguucugaugangaaacacaggu

SEQ ID NO: 1244 - DNA, 27 bp; single-stranded, linear
  The letter "N" stands for the stem II region of a HH ribozyme.
ggcugucgcugaugangaaaugugcug

SEQ ID NO: 1245 - DNA, 27 bp; single-stranded, linear
  The letter "N" stands for the stem II region of a HH ribozyme.
gggcuguccugaugangaaaaugugcu

SEQ ID NO: 1246 - DNA, 27 bp; single-stranded, linear
  The letter "N" stands for the stem II region of a HH ribozyme.
uccaggcucugaugangaaauuuggug

SEQ ID NO: 1247 - DNA, 27 bp; single-stranded, linear
  The letter "N" stands for the stem II region of a HH ribozyme.
guccaggccugaugangaaaauuuggu

SEQ ID NO: 1248 - DNA, 27 bp; single-stranded, linear
  The letter "N" stands for the stem II region of a HH ribozyme.
ccugcuggcugaugangaaagucaggg

SEQ ID NO: 1249 - DNA, 27 bp; single-stranded, linear
  The letter "N" stands for the stem II region of a HH ribozyme.
ugggaaagcugaugangaaaguccugc

SEQ ID NO: 1250 - DNA, 27 bp; single-stranded, linear
  The letter "N" stands for the stem II region of a HH ribozyme.
uugggaaacugaugangaaaaguccug

SEQ ID NO: 1251 - DNA, 27 bp; single-stranded, linear
  The letter "N" stands for the stem II region of a HH ribozyme.
ccuugggacugaugangaaagaagucc

SEQ ID NO: 1252 - DNA, 27 bp; single-stranded, linear
  The letter "N" stands for the stem II region of a HH ribozyme.
uccuugggcugaugangaaaagaaguc

SEQ ID NO: 1253 - DNA, 27 bp; single-stranded, linear
  The letter "N" stands for the stem II region of a HH ribozyme.
uuccuuggcugaugangaaaaagaagu

SEQ ID NO: 1254 - DNA, 27 bp; single-stranded, linear
  The letter "N" stands for the stem II region of a HH ribozyme.
cccuuaaacugaugangaaaugccauu

SEQ ID NO: 1255 - DNA, 27 bp; single-stranded, linear
  The letter "N" stands for the stem II region of a HH ribozyme.
agcccuuacugaugangaaagaugcca

SEQ ID NO: 1256 - DNA, 27 bp; single-stranded, linear
  The letter "N" stands for the stem II region of a HH ribozyme.
gagcccuucugaugangaaaagaugcc

SEQ ID NO: 1257 - DNA, 27 bp; single-stranded, linear
  The letter "N" stands for the stem II region of a HH ribozyme.
ggagcccucugaugangaaaaagaugc

SEQ ID NO: 1258 - DNA, 27 bp; single-stranded, linear
  The letter "N" stands for the stem II region of a HH ribozyme.
cagcugugcugaugangaaagcccuua

SEQ ID NO: 1259 - DNA, 27 bp; single-stranded, linear
  The letter "N" stands for the stem II region of a HH ribozyme.
cccuuaggcugaugangaaauucugca

SEQ ID NO: 1260 - DNA, 27 bp; single-stranded, linear
  The letter "N" stands for the stem II region of a HH ribozyme.
gcgacccucugaugangaaagguauuc

SEQ ID NO: 1261 - DNA, 27 bp; single-stranded, linear
  The letter "N" stands for the stem II region of a HH ribozyme.
uguggcgccugaugangaaacccuuag

SEQ ID NO: 1262 - DNA, 27 bp; single-stranded, linear
  The letter "N" stands for the stem II region of a HH ribozyme.
cuccaauacugaugangaaauucacug

SEQ ID NO: 1263 - DNA, 27 bp; single-stranded, linear
  The letter "N" stands for the stem II region of a HH ribozyme.
gcuccaaucugaugangaaaauucacu

SEQ ID NO: 1264 - DNA, 27 bp; single-stranded, linear
  The letter "N" stands for the stem II region of a HH ribozyme.
ugcuccaacugaugangaaaaauucac

SEQ ID NO: 1265 - DNA, 27 bp; single-stranded, linear
  The letter "N" stands for the stem II region of a HH ribozyme.
caugcucccugaugangaaauaaauuc

SEQ ID NO: 1266 - DNA, 27 bp; single-stranded, linear
  The letter "N" stands for the stem II region of a HH ribozyme.
gcucauaccugaugangaaauccuccg

SEQ ID NO: 1267 - DNA, 27 bp; single-stranded, linear
  The letter "N" stands for the stem II region of a HH ribozyme.
agggcucacugaugangaaacuauccu

SEQ ID NO: 1268 - DNA, 27 bp; single-stranded, linear
  The letter "N" stands for the stem II region of a HH ribozyme.
uggauuuucugaugangaaagggcuca

SEQ ID NO: 1269 - DNA, 27 bp; single-stranded, linear
  The letter "N" stands for the stem II region of a HH ribozyme.
agagucugcugaugangaaauuuuuag

SEQ ID NO: 1270 - DNA, 27 bp; single-stranded, linear
  The letter "N" stands for the stem II region of a HH ribozyme.
uaucgaaacugaugangaaagucugga

SEQ ID NO: 1271 - DNA, 27 bp; single-stranded, linear
  The letter "N" stands for the stem II region of a HH ribozyme.
gguaucgacugaugangaaagagucug

SEQ ID NO: 1272 - DNA, 27 bp; single-stranded, linear
  The letter "N" stands for the stem II region of a HH ribozyme.
ggguaucgcugaugangaaaagagucu

SEQ ID NO: 1273 - DNA, 27 bp; single-stranded, linear
  The letter "N" stands for the stem II region of a HH ribozyme.
uggguauccugaugangaaaaagaguc

SEQ ID NO: 1274 - DNA, 27 bp; single-stranded, linear
  The letter "N" stands for the stem II region of a HH ribozyme.
guccugggcugaugangaaaucgaaag

SEQ ID NO: 1275 - DNA, 27 bp; single-stranded, linear
  The letter "N" stands for the stem II region of a HH ribozyme.
ggauggagcugaugangaaaccugcug

SEQ ID NO: 1276 - DNA, 27 bp; single-stranded, linear
  The letter "N" stands for the stem II region of a HH ribozyme.
uugggaugcugaugangaaaggaccug

SEQ ID NO: 1277 - DNA, 27 bp; single-stranded, linear
  The letter "N" stands for the stem II region of a HH ribozyme.
gcuguuggcugaugangaaauggagga

SEQ ID NO: 1278 - DNA, 27 bp; single-stranded, linear
  The letter "N" stands for the stem II region of a HH ribozyme.
uaagagcucugaugangaaaugcgggc

SEQ ID NO: 1279 - DNA, 27 bp; single-stranded, linear
  The letter "N" stands for the stem II region of a HH ribozyme.
cuaagagccugaugangaaaaugcggg

SEQ ID NO: 1280 - DNA, 27 bp; single-stranded, linear
  The letter "N" stands for the stem II region of a HH ribozyme.
gggucuaacugaugangaaagcuaaug

SEQ ID NO: 1281 - DNA, 27 bp; single-stranded, linear
  The letter "N" stands for the stem II region of a HH ribozyme.
gugggucucugaugangaaagagcuaa

SEQ ID NO: 1282 - DNA, 27 bp; single-stranded, linear
  The letter "N" stands for the stem II region of a HH ribozyme.
uguggguccugaugangaaaagagcua

SEQ ID NO: 1283 - DNA, 27 bp; single-stranded, linear
  The letter "N" stands for the stem II region of a HH ribozyme.
cguugcaacugaugangaaaccagucu

SEQ ID NO: 1284 - DNA, 27 bp; single-stranded, linear
  The letter "N" stands for the stem II region of a HH ribozyme.
acguugcacugaugangaaaaccaguc

SEQ ID NO: 1285 - DNA, 27 bp; single-stranded, linear
  The letter "N" stands for the stem II region of a HH ribozyme.
aacguugccugaugangaaaaaccagu

SEQ ID NO: 1286 - DNA, 27 bp; single-stranded, linear
  The letter "N" stands for the stem II region of a HH ribozyme.
ucgguguacugaugangaaacguugca

SEQ ID NO: 1287 - DNA, 27 bp; single-stranded, linear
  The letter "N" stands for the stem II region of a HH ribozyme.
gucggugucugaugangaaaacguugc

SEQ ID NO: 1288 - DNA, 27 bp; single-stranded, linear
  The letter "N" stands for the stem II region of a HH ribozyme.
agucggugcugaugangaaaaacguug

SEQ ID NO: 1289 - DNA, 27 bp; single-stranded, linear
  The letter "N" stands for the stem II region of a HH ribozyme.
uuccuggccugaugangaaagucggug

SEQ ID NO: 1290 - DNA, 27 bp; single-stranded, linear
  The letter "N" stands for the stem II region of a HH ribozyme.
gguggaagcugaugangaaacuuccug

SEQ ID NO: 1291 - DNA, 27 bp; single-stranded, linear
  The letter "N" stands for the stem II region of a HH ribozyme.
cgagguggcugaugangaaaguacuuc

SEQ ID NO: 1292 - DNA, 27 bp; single-stranded, linear
  The letter "N" stands for the stem II region of a HH ribozyme.
ccgaggugcugaugangaaaaguacuu

SEQ ID NO: 1293 - DNA, 27 bp; single-stranded, linear
  The letter "N" stands for the stem II region of a HH ribozyme.
augugccccugaugangaaagguggaa

SEQ ID NO: 1294 - DNA, 27 bp; single-stranded, linear
  The letter "N" stands for the stem II region of a HH ribozyme.
cuucccaacugaugangaaaugugccc

SEQ ID NO: 1295 - DNA, 27 bp; single-stranded, linear
  The letter "N" stands for the stem II region of a HH ribozyme.
acuucccacugaugangaaaaugugcc

SEQ ID NO: 1296 - DNA, 27 bp; single-stranded, linear
  The letter "N" stands for the stem II region of a HH ribozyme.
aacuuccccugaugangaaaaaugugc

SEQ ID NO: 1297 - DNA, 27 bp; single-stranded, linear
  The letter "N" stands for the stem II region of a HH ribozyme.
aggaaugccugaugangaaacuuccca

SEQ ID NO: 1298 - DNA, 27 bp; single-stranded, linear
  The letter "N" stands for the stem II region of a HH ribozyme.
gacaaaggcugaugangaaaugcaacu

SEQ ID NO: 1299 - DNA, 27 bp; single-stranded, linear
  The letter "N" stands for the stem II region of a HH ribozyme.
agacaaagcugaugangaaaaugcaac

SEQ ID NO: 1300 - DNA, 27 bp; single-stranded, linear
  The letter "N" stands for the stem II region of a HH ribozyme.
ugaagacacugaugangaaaggaaugc

SEQ ID NO: 1301 - DNA, 27 bp; single-stranded, linear
  The letter "N" stands for the stem II region of a HH ribozyme.
uugaagaccugaugangaaaaggaaug

SEQ ID NO: 1302 - DNA, 27 bp; single-stranded, linear
  The letter "N" stands for the stem II region of a HH ribozyme.
aguuugaacugaugangaaacaaagga

SEQ ID NO: 1303 - DNA, 27 bp; single-stranded, linear
  The letter "N" stands for the stem II region of a HH ribozyme.
acaguuugcugaugangaaagacaaag

SEQ ID NO: 1304 - DNA, 27 bp; single-stranded, linear
  The letter "N" stands for the stem II region of a HH ribozyme.
cacaguuucugaugangaaaagacaaa

SEQ ID NO: 1305 - DNA, 27 bp; single-stranded, linear
  The letter "N" stands for the stem II region of a HH ribozyme.
uuucuguacugaugangaaaugcuuca

SEQ ID NO: 1306 - DNA, 27 bp; single-stranded, linear
  The letter "N" stands for the stem II region of a HH ribozyme.
guuucugucugaugangaaaaugcuuc

SEQ ID NO: 1307 - DNA, 27 bp; single-stranded, linear
  The letter "N" stands for the stem II region of a HH ribozyme.
cguuucugcugaugangaaaaaugcuu

SEQ ID NO: 1308 - DNA, 27 bp; single-stranded, linear
  The letter "N" stands for the stem II region of a HH ribozyme.
ucuugcugcugaugangaaaugcguuu

SEQ ID NO: 1309 - DNA, 27 bp; single-stranded, linear
  The letter "N" stands for the stem II region of a HH ribozyme.
agggacaacugaugangaaauucuugc

SEQ ID NO: 1310 - DNA, 27 bp; single-stranded, linear
  The letter "N" stands for the stem II region of a HH ribozyme.
aaagggaccugaugangaaauauucuu

SEQ ID NO: 1311 - DNA, 27 bp; single-stranded, linear
  The letter "N" stands for the stem II region of a HH ribozyme.
cucaaaggcugaugangaaacaauauu

SEQ ID NO: 1312 - DNA, 27 bp; single-stranded, linear
  The letter "N" stands for the stem II region of a HH ribozyme.
ucugcucacugaugangaaagggacaa

SEQ ID NO: 1313 - DNA, 27 bp; single-stranded, linear
  The letter "N" stands for the stem II region of a HH ribozyme.
uucugcuccugaugangaaaagggaca

SEQ ID NO: 1314 - DNA, 27 bp; single-stranded, linear
  The letter "N" stands for the stem II region of a HH ribozyme.
gaaagauacugaugangaaauuucugc

SEQ ID NO: 1315 - DNA, 27 bp; single-stranded, linear
  The letter "N" stands for the stem II region of a HH ribozyme.
ugaaagaucugaugangaaaauuucug

SEQ ID NO: 1316 - DNA, 27 bp; single-stranded, linear
  The letter "N" stands for the stem II region of a HH ribozyme.
uugaaagacugaugangaaaaauuucu

SEQ ID NO: 1317 - DNA, 27 bp; single-stranded, linear
  The letter "N" stands for the stem II region of a HH ribozyme.
cuuugaaacugaugangaaauaaauuu

SEQ ID NO: 1318 - DNA, 27 bp; single-stranded, linear
  The letter "N" stands for the stem II region of a HH ribozyme.
cucuuugacugaugangaaagauaaau

SEQ ID NO: 1319 - DNA, 27 bp; single-stranded, linear
  The letter "N" stands for the stem II region of a HH ribozyme.
ccucuuugcugaugangaaaagauaaa

SEQ ID NO: 1320 - DNA, 27 bp; single-stranded, linear
  The letter "N" stands for the stem II region of a HH ribozyme.
accucuuucugaugangaaaaagauaa

SEQ ID NO: 1321 - DNA, 27 bp; single-stranded, linear
  The letter "N" stands for the stem II region of a HH ribozyme.
uucaaauacugaugangaaaccucuuu

SEQ ID NO: 1322 - DNA, 27 bp; single-stranded, linear
  The letter "N" stands for the stem II region of a HH ribozyme.
uuuucaaacugaugangaaauaccucu

SEQ ID NO: 1323 - DNA, 27 bp; single-stranded, linear
  The letter "N" stands for the stem II region of a HH ribozyme.
uuuuuucacugaugangaaauauaccu

SEQ ID NO: 1324 - DNA, 27 bp; single-stranded, linear
  The letter "N" stands for the stem II region of a HH ribozyme.
uuuuuuuccugaugangaaaauauacc

SEQ ID NO: 1325 - DNA, 27 bp; single-stranded, linear
  The letter "N" stands for the stem II region of a HH ribozyme.
cucacauacugaugangaaacuuuuuu

SEQ ID NO: 1326 - DNA, 27 bp; single-stranded, linear
  The letter "N" stands for the stem II region of a HH ribozyme.
uccucacacugaugangaaauacuuuu

SEQ ID NO: 1327 - DNA, 27 bp; single-stranded, linear
  The letter "N" stands for the stem II region of a HH ribozyme.
ucaauaaacugaugangaaauccucac

SEQ ID NO: 1328 - DNA, 27 bp; single-stranded, linear
  The letter "N" stands for the stem II region of a HH ribozyme.
aucaauaacugaugangaaaauccuca

SEQ ID NO: 1329 - DNA, 27 bp; single-stranded, linear
  The letter "N" stands for the stem II region of a HH ribozyme.
aaucaauacugaugangaaaaauccuc

SEQ ID NO: 1330 - DNA, 27 bp; single-stranded, linear
  The letter "N" stands for the stem II region of a HH ribozyme.
caaucaaucugaugangaaaaaauccu

SEQ ID NO: 1331 - DNA, 27 bp; single-stranded, linear
  The letter "N" stands for the stem II region of a HH ribozyme.
ccaaucaacugaugangaaaaaaaucc

SEQ ID NO: 1332 - DNA, 27 bp; single-stranded, linear
  The letter "N" stands for the stem II region of a HH ribozyme.
ccccaauccugaugangaaauaaaaau

SEQ ID NO: 1333 - DNA, 27 bp; single-stranded, linear
  The letter "N" stands for the stem II region of a HH ribozyme.
agaucccccugaugangaaaucaauaa

SEQ ID NO: 1334 - DNA, 27 bp; single-stranded, linear
  The letter "N" stands for the stem II region of a HH ribozyme.
aacuccaacugaugangaaauccccaa

SEQ ID NO: 1335 - DNA, 27 bp; single-stranded, linear
  The letter "N" stands for the stem II region of a HH ribozyme.
aaaacucccugaugangaaagaucccc

SEQ ID NO: 1336 - DNA, 27 bp; single-stranded, linear
  The letter "N" stands for the stem II region of a HH ribozyme.
caaugaaacugaugangaaacuccaag

SEQ ID NO: 1337 - DNA, 27 bp; single-stranded, linear
  The letter "N" stands for the stem II region of a HH ribozyme.
acaaugaacugaugangaaaacuccaa

SEQ ID NO: 1338 - DNA, 27 bp; single-stranded, linear
  The letter "N" stands for the stem II region of a HH ribozyme.
gacaaugacugaugangaaaaacucca

SEQ ID NO: 1339 - DNA, 27 bp; single-stranded, linear
  The letter "N" stands for the stem II region of a HH ribozyme.
cgacaaugcugaugangaaaaaacucc

SEQ ID NO: 1340 - DNA, 27 bp; single-stranded, linear
  The letter "N" stands for the stem II region of a HH ribozyme.
gcgacaaucugaugangaaaaaaacuc

SEQ ID NO: 1341 - DNA, 27 bp; single-stranded, linear
  The letter "N" stands for the stem II region of a HH ribozyme.
auagcgaccugaugangaaaugaaaaa

SEQ ID NO: 1342 - DNA, 27 bp; single-stranded, linear
  The letter "N" stands for the stem II region of a HH ribozyme.
ucaauagccugaugangaaacaaugaa

SEQ ID NO: 1343 - DNA, 27 bp; single-stranded, linear
  The letter "N" stands for the stem II region of a HH ribozyme.
aaaaucaacugaugangaaagcgacaa

SEQ ID NO: 1344 - DNA, 27 bp; single-stranded, linear
  The letter "N" stands for the stem II region of a HH ribozyme.
uaaaaauccugaugangaaauagcgac

SEQ ID NO: 1345 - DNA, 27 bp; single-stranded, linear
  The letter "N" stands for the stem II region of a HH ribozyme.
gaaguaaacugaugangaaaucaauag

SEQ ID NO: 1346 - DNA, 27 bp; single-stranded, linear
  The letter "N" stands for the stem II region of a HH ribozyme.
ugaaguaacugaugangaaaaucaaua

SEQ ID NO: 1347 - DNA, 27 bp; single-stranded, linear
  The letter "N" stands for the stem II region of a HH ribozyme.
uugaaguacugaugangaaaaaucaau

SEQ ID NO: 1348 - DNA, 27 bp; single-stranded, linear
  The letter "N" stands for the stem II region of a HH ribozyme.
auugaagucugaugangaaaaaaucaa

SEQ ID NO: 1349 - DNA, 27 bp; single-stranded, linear
  The letter "N" stands for the stem II region of a HH ribozyme.
cauugaagcugaugangaaaaaaauca

SEQ ID NO: 1350 - DNA, 27 bp; single-stranded, linear
  The letter "N" stands for the stem II region of a HH ribozyme.
gcccauugcugaugangaaaguaaaaa

SEQ ID NO: 1351 - DNA, 27 bp; single-stranded, linear
  The letter "N" stands for the stem II region of a HH ribozyme.
agcccauucugaugangaaaaguaaaa

SEQ ID NO: 1352 - DNA, 27 bp; single-stranded, linear
  The letter "N" stands for the stem II region of a HH ribozyme.
uguuggaacugaugangaaagcccauu

SEQ ID NO: 1353 - DNA, 27 bp; single-stranded, linear
  The letter "N" stands for the stem II region of a HH ribozyme.
cuuguuggcugaugangaaagagccca

SEQ ID NO: 1354 - DNA, 27 bp; single-stranded, linear
  The letter "N" stands for the stem II region of a HH ribozyme.
ccuuguugcugaugangaaaagagccc

SEQ ID NO: 1355 - DNA, 27 bp; single-stranded, linear
  The letter "N" stands for the stem II region of a HH ribozyme.
cuaccagccugaugangaaagcuucuu

SEQ ID NO: 1356 - DNA, 27 bp; single-stranded, linear
  The letter "N" stands for the stem II region of a HH ribozyme.
gcaagugccugaugangaaaccagcaa

SEQ ID NO: 1357 - DNA, 27 bp; single-stranded, linear
  The letter "N" stands for the stem II region of a HH ribozyme.
aggguagccugaugangaaagugcuac

SEQ ID NO: 1358 - DNA, 27 bp; single-stranded, linear
  The letter "N" stands for the stem II region of a HH ribozyme.
acucagggcugaugangaaagcaagug

SEQ ID NO: 1359 - DNA, 27 bp; single-stranded, linear
  The letter "N" stands for the stem II region of a HH ribozyme.
ccuggaugcugaugangaaacucaggg

SEQ ID NO: 1360 - DNA, 27 bp; single-stranded, linear
  The letter "N" stands for the stem II region of a HH ribozyme.
gccuggaucugaugangaaaacucagg

SEQ ID NO: 1361 - DNA, 27 bp; single-stranded, linear
  The letter "N" stands for the stem II region of a HH ribozyme.
ugggccugcugaugangaaaugaacuc

SEQ ID NO: 1362 - DNA, 27 bp; single-stranded, linear
  The letter "N" stands for the stem II region of a HH ribozyme.
cucuggaacugaugangaaacuugugg

SEQ ID NO: 1363 - DNA, 27 bp; single-stranded, linear
  The letter "N" stands for the stem II region of a HH ribozyme.
uccucuggcugaugangaaagacuugu

SEQ ID NO: 1364 - DNA, 27 bp; single-stranded, linear
  The letter "N" stands for the stem II region of a HH ribozyme.
auccucugcugaugangaaaagacuug

SEQ ID NO: 1365 - DNA, 27 bp; single-stranded, linear
  The letter "N" stands for the stem II region of a HH ribozyme.
cuggaauccugaugangaaagcauccu

SEQ ID NO: 1366 - DNA, 27 bp; single-stranded, linear
  The letter "N" stands for the stem II region of a HH ribozyme.
accacuggcugaugangaaaucaagca

SEQ ID NO: 1367 - DNA, 27 bp; single-stranded, linear
  The letter "N" stands for the stem II region of a HH ribozyme.
aaccacugcugaugangaaaaucaagc

SEQ ID NO: 1368 - DNA, 27 bp; single-stranded, linear
  The letter "N" stands for the stem II region of a HH ribozyme.
ugaagcagcugaugangaaaccacugg

SEQ ID NO: 1369 - DNA, 27 bp; single-stranded, linear
  The letter "N" stands for the stem II region of a HH ribozyme.
uugaagcacugaugangaaaaccacug

SEQ ID NO: 1370 - DNA, 27 bp; single-stranded, linear
  The letter "N" stands for the stem II region of a HH ribozyme.
aagccuugcugaugangaaagcagaac

SEQ ID NO: 1371 - DNA, 27 bp; single-stranded, linear
  The letter "N" stands for the stem II region of a HH ribozyme.
gaagccuucugaugangaaaagcagaa

SEQ ID NO: 1372 - DNA, 27 bp; single-stranded, linear
  The letter "N" stands for the stem II region of a HH ribozyme.
ugcaguggcugaugangaaagccuuga

SEQ ID NO: 1373 - DNA, 27 bp; single-stranded, linear
  The letter "N" stands for the stem II region of a HH ribozyme.
uugcagugcugaugangaaaagccuug

SEQ ID NO: 1374 - DNA, 27 bp; single-stranded, linear
  The letter "N" stands for the stem II region of a HH ribozyme.
uggaucuucugaugangaaaguguuuu

SEQ ID NO: 1375 - DNA, 27 bp; single-stranded, linear
  The letter "N" stands for the stem II region of a HH ribozyme.
ccuucuugcugaugangaaaucuuuag

SEQ ID NO: 1376 - DNA, 27 bp; single-stranded, linear
  The letter "N" stands for the stem II region of a HH ribozyme.
gggccaugcugaugangaaaggccuuc

SEQ ID NO: 1377 - DNA, 27 bp; single-stranded, linear
  The letter "N" stands for the stem II region of a HH ribozyme.
ggggccaucugaugangaaaaggccuu

SEQ ID NO: 1378 - DNA, 27 bp; single-stranded, linear
  The letter "N" stands for the stem II region of a HH ribozyme.
acaguacccugaugangaaauccggcc

SEQ ID NO: 1379 - DNA, 27 bp; single-stranded, linear
  The letter "N" stands for the stem II region of a HH ribozyme.
ugauacagcugaugangaaaccgaucc

SEQ ID NO: 1380 - DNA, 27 bp; single-stranded, linear
  The letter "N" stands for the stem II region of a HH ribozyme.
ugacuugacugaugangaaacaguacc

SEQ ID NO: 1381 - DNA, 27 bp; single-stranded, linear
  The letter "N" stands for the stem II region of a HH ribozyme.
caugacuucugaugangaaauacagua

SEQ ID NO: 1382 - DNA, 27 bp; single-stranded, linear
  The letter "N" stands for the stem II region of a HH ribozyme.
ccugccaucugaugangaaacuugaua

SEQ ID NO: 1383 - DNA, 27 bp; single-stranded, linear
  The letter "N" stands for the stem II region of a HH ribozyme.
uccuacugcugaugangaaaccugcca

SEQ ID NO: 1384 - DNA, 27 bp; single-stranded, linear
  The letter "N" stands for the stem II region of a HH ribozyme.
gcuuaucccugaugangaaacuguacc

SEQ ID NO: 1385 - DNA, 27 bp; single-stranded, linear
  The letter "N" stands for the stem II region of a HH ribozyme.
gaguggcucugaugangaaauccuacu

SEQ ID NO: 1386 - DNA, 27 bp; single-stranded, linear
  The letter "N" stands for the stem II region of a HH ribozyme.
aagggacacugaugangaaaguggcuu

SEQ ID NO: 1387 - DNA, 27 bp; single-stranded, linear
  The letter "N" stands for the stem II region of a HH ribozyme.
caggaaggcugaugangaaacagagug

SEQ ID NO: 1388 - DNA, 27 bp; single-stranded, linear
  The letter "N" stands for the stem II region of a HH ribozyme.
ugcccaggcugaugangaaagggacag

SEQ ID NO: 1389 - DNA, 27 bp; single-stranded, linear
  The letter "N" stands for the stem II region of a HH ribozyme.
uugcccagcugaugangaaaagggaca

SEQ ID NO: 1390 - DNA, 27 bp; single-stranded, linear
  The letter "N" stands for the stem II region of a HH ribozyme.
uaaggaagcugaugangaaauucaucc

SEQ ID NO: 1391 - DNA, 27 bp; single-stranded, linear
  The letter "N" stands for the stem II region of a HH ribozyme.
cuaaggaacugaugangaaaauucauc

SEQ ID NO: 1392 - DNA, 27 bp; single-stranded, linear
  The letter "N" stands for the stem II region of a HH ribozyme.
gucuaaggcugaugangaaagaauuca

SEQ ID NO: 1393 - DNA, 27 bp; single-stranded, linear
  The letter "N" stands for the stem II region of a HH ribozyme.
agucuaagcugaugangaaaagaauuc

SEQ ID NO: 1394 - DNA, 27 bp; single-stranded, linear
  The letter "N" stands for the stem II region of a HH ribozyme.
guaagucucugaugangaaaggaagaa

SEQ ID NO: 1395 - DNA, 27 bp; single-stranded, linear
  The letter "N" stands for the stem II region of a HH ribozyme.
aguaaguccugaugangaaaaggaaga

SEQ ID NO: 1396 - DNA, 27 bp; single-stranded, linear
  The letter "N" stands for the stem II region of a HH ribozyme.
acaaaagucugaugangaaagucuaag

SEQ ID NO: 1397 - DNA, 27 bp; single-stranded, linear
  The letter "N" stands for the stem II region of a HH ribozyme.
uacaaaagcugaugangaaaagucuaa

SEQ ID NO: 1398 - DNA, 27 bp; single-stranded, linear
  The letter "N" stands for the stem II region of a HH ribozyme.
uuuuacaacugaugangaaaguaaguc

SEQ ID NO: 1399 - DNA, 27 bp; single-stranded, linear
  The letter "N" stands for the stem II region of a HH ribozyme.
uuuuuacacugaugangaaaaguaagu

SEQ ID NO: 1400 - DNA, 27 bp; single-stranded, linear
  The letter "N" stands for the stem II region of a HH ribozyme.
auuuuuaccugaugangaaaaaguaag

SEQ ID NO: 1401 - DNA, 27 bp; single-stranded, linear
  The letter "N" stands for the stem II region of a HH ribozyme.
gacauuuucugaugangaaacaaaagu

SEQ ID NO: 1402 - DNA, 27 bp; single-stranded, linear
  The letter "N" stands for the stem II region of a HH ribozyme.
accgugggcugaugangaaacauuuuu

SEQ ID NO: 1403 - DNA, 27 bp; single-stranded, linear
  The letter "N" stands for the stem II region of a HH ribozyme.
ggaguaagcugaugangaaaccguggg

SEQ ID NO: 1404 - DNA, 27 bp; single-stranded, linear
  The letter "N" stands for the stem II region of a HH ribozyme.
uggggagucugaugangaaaguaccgu

SEQ ID NO: 1405 - DNA, 27 bp; single-stranded, linear
  The letter "N" stands for the stem II region of a HH ribozyme.
guggggagcugaugangaaaaguaccg

SEQ ID NO: 1406 - DNA, 27 bp; single-stranded, linear
  The letter "N" stands for the stem II region of a HH ribozyme.
ucagugggcugaugangaaaguaagua

SEQ ID NO: 1407 - DNA, 27 bp; single-stranded, linear
  The letter "N" stands for the stem II region of a HH ribozyme.
ugacuggacugaugangaaaccacugg

SEQ ID NO: 1408 - DNA, 27 bp; single-stranded, linear
  The letter "N" stands for the stem II region of a HH ribozyme.
augacuggcugaugangaaaaccacug

SEQ ID NO: 1409 - DNA, 27 bp; single-stranded, linear
  The letter "N" stands for the stem II region of a HH ribozyme.
caugacugcugaugangaaaaaccacu

SEQ ID NO: 1410 - DNA, 27 bp; single-stranded, linear
  The letter "N" stands for the stem II region of a HH ribozyme.
acgcucaucugaugangaaacuggaaa

SEQ ID NO: 1411 - DNA, 27 bp; single-stranded, linear
  The letter "N" stands for the stem II region of a HH ribozyme.
gucagucucugaugangaaacgcucau

SEQ ID NO: 1412 - DNA, 27 bp; single-stranded, linear
  The letter "N" stands for the stem II region of a HH ribozyme.
agucaguccugaugangaaaacgcuca

SEQ ID NO: 1413 - DNA, 27 bp; single-stranded, linear
  The letter "N" stands for the stem II region of a HH ribozyme.
agacaaaccugaugangaaagucaguc

SEQ ID NO: 1414 - DNA, 27 bp; single-stranded, linear
  The letter "N" stands for the stem II region of a HH ribozyme.
ggaagacacugaugangaaacaaguca

SEQ ID NO: 1415 - DNA, 27 bp; single-stranded, linear
  The letter "N" stands for the stem II region of a HH ribozyme.
uggaagaccugaugangaaaacaaguc

SEQ ID NO: 1416 - DNA, 27 bp; single-stranded, linear
  The letter "N" stands for the stem II region of a HH ribozyme.
gaauggaacugaugangaaacaaacaa

SEQ ID NO: 1417 - DNA, 27 bp; single-stranded, linear
  The letter "N" stands for the stem II region of a HH ribozyme.
uggaauggcugaugangaaagacaaac

SEQ ID NO: 1418 - DNA, 27 bp; single-stranded, linear
  The letter "N" stands for the stem II region of a HH ribozyme.
auggaaugcugaugangaaaagacaaa

SEQ ID NO: 1419 - DNA, 27 bp; single-stranded, linear
  The letter "N" stands for the stem II region of a HH ribozyme.
aacaauggcugaugangaaauggaaga

SEQ ID NO: 1420 - DNA, 27 bp; single-stranded, linear
  The letter "N" stands for the stem II region of a HH ribozyme.
aaacaaugcugaugangaaaauggaag

SEQ ID NO: 1421 - DNA, 27 bp; single-stranded, linear
  The letter "N" stands for the stem II region of a HH ribozyme.
uucaaaaccugaugangaaauggaaug

SEQ ID NO: 1422 - DNA, 27 bp; single-stranded, linear
  The letter "N" stands for the stem II region of a HH ribozyme.
aguuucaacugaugangaaacaaugga

SEQ ID NO: 1423 - DNA, 27 bp; single-stranded, linear
  The letter "N" stands for the stem II region of a HH ribozyme.
gaguuucacugaugangaaaacaaugg

SEQ ID NO: 1424 - DNA, 27 bp; single-stranded, linear
  The letter "N" stands for the stem II region of a HH ribozyme.
ugaguuuccugaugangaaaaacaaug

SEQ ID NO: 1425 - DNA, 27 bp; single-stranded, linear
  The letter "N" stands for the stem II region of a HH ribozyme.
ggcauacucugaugangaaaguuucaa

SEQ ID NO: 1426 - DNA, 27 bp; single-stranded, linear
  The letter "N" stands for the stem II region of a HH ribozyme.
gggcggcacugaugangaaacugaguu

SEQ ID NO: 1427 - DNA, 27 bp; single-stranded, linear
  The letter "N" stands for the stem II region of a HH ribozyme.
gacagcaacugaugangaaacaggggc

SEQ ID NO: 1428 - DNA, 27 bp; single-stranded, linear
  The letter "N" stands for the stem II region of a HH ribozyme.
augacagccugaugangaaagacaggg

SEQ ID NO: 1429 - DNA, 27 bp; single-stranded, linear
  The letter "N" stands for the stem II region of a HH ribozyme.
gauuucaucugaugangaaacagcaag

SEQ ID NO: 1430 - DNA, 27 bp; single-stranded, linear
  The letter "N" stands for the stem II region of a HH ribozyme.
cucuugcucugaugangaaauuucaug

SEQ ID NO: 1431 - DNA, 27 bp; single-stranded, linear
  The letter "N" stands for the stem II region of a HH ribozyme.
uauuauuucugaugangaaauguguca

SEQ ID NO: 1432 - DNA, 27 bp; single-stranded, linear
  The letter "N" stands for the stem II region of a HH ribozyme.
cgaguuaucugaugangaaauuugaug

SEQ ID NO: 1433 - DNA, 27 bp; single-stranded, linear
  The letter "N" stands for the stem II region of a HH ribozyme.
auccgagucugaugangaaauuauuug

SEQ ID NO: 1434 - DNA, 27 bp; single-stranded, linear
  The letter "N" stands for the stem II region of a HH ribozyme.
uggaaucccugaugangaaaguuauua

SEQ ID NO: 1435 - DNA, 27 bp; single-stranded, linear
  The letter "N" stands for the stem II region of a HH ribozyme.
ugggcuggcugaugangaaauccgagu

SEQ ID NO: 1436 - DNA, 27 bp; single-stranded, linear
  The letter "N" stands for the stem II region of a HH ribozyme.
gugggcugcugaugangaaaauccgag

SEQ ID NO: 1437 - DNA, 27 bp; single-stranded, linear
  The letter "N" stands for the stem II region of a HH ribozyme.
augaaucccugaugangaaaugugggc

SEQ ID NO: 1438 - DNA, 27 bp; single-stranded, linear
  The letter "N" stands for the stem II region of a HH ribozyme.
ugcugaugcugaugangaaauccaaug

SEQ ID NO: 1439 - DNA, 27 bp; single-stranded, linear
  The letter "N" stands for the stem II region of a HH ribozyme.
augcugaucugaugangaaaauccaau

SEQ ID NO: 1440 - DNA, 27 bp; single-stranded, linear
  The letter "N" stands for the stem II region of a HH ribozyme.
caaaugcucugaugangaaaugaaucc

SEQ ID NO: 1441 - DNA, 27 bp; single-stranded, linear
  The letter "N" stands for the stem II region of a HH ribozyme.
uugguccacugaugangaaaugcugau

SEQ ID NO: 1442 - DNA, 27 bp; single-stranded, linear
  The letter "N" stands for the stem II region of a HH ribozyme.
auuggucccugaugangaaaaugcuga

SEQ ID NO: 1443 - DNA, 27 bp; single-stranded, linear
  The letter "N" stands for the stem II region of a HH ribozyme.
cugugggccugaugangaaauuggucc

SEQ ID NO: 1444 - DNA, 27 bp; single-stranded, linear
  The letter "N" stands for the stem II region of a HH ribozyme.
uccuuaggcugaugangaaauuccaca

SEQ ID NO: 1445 - DNA, 27 bp; single-stranded, linear
  The letter "N" stands for the stem II region of a HH ribozyme.
guuauccucugaugangaaagguauuc

SEQ ID NO: 1446 - DNA, 27 bp; single-stranded, linear
  The letter "N" stands for the stem II region of a HH ribozyme.
agcggugucugaugangaaauccuuag

SEQ ID NO: 1447 - DNA, 27 bp; single-stranded, linear
  The letter "N" stands for the stem II region of a HH ribozyme.
gagaacaacugaugangaaagcggugu

SEQ ID NO: 1448 - DNA, 27 bp; single-stranded, linear
  The letter "N" stands for the stem II region of a HH ribozyme.
cgagaacacugaugangaaaagcggug

SEQ ID NO: 1449 - DNA, 27 bp; single-stranded, linear
  The letter "N" stands for the stem II region of a HH ribozyme.
gcgagaaccugaugangaaaaagcggu

SEQ ID NO: 1450 - DNA, 27 bp; single-stranded, linear
  The letter "N" stands for the stem II region of a HH ribozyme.
uuugcgagcugaugangaaacaaaagc

SEQ ID NO: 1451 - DNA, 27 bp; single-stranded, linear
  The letter "N" stands for the stem II region of a HH ribozyme.
uuuugcgacugaugangaaaacaaaag

SEQ ID NO: 1452 - DNA, 27 bp; single-stranded, linear
  The letter "N" stands for the stem II region of a HH ribozyme.
guuuuugccugaugangaaagaacaaa

SEQ ID NO: 1453 - DNA, 27 bp; single-stranded, linear
  The letter "N" stands for the stem II region of a HH ribozyme.
uuaggagacugaugangaaacguuuuu

SEQ ID NO: 1454 - DNA, 27 bp; single-stranded, linear
  The letter "N" stands for the stem II region of a HH ribozyme.
aauuaggacugaugangaaauacguuu

SEQ ID NO: 1455 - DNA, 27 bp; single-stranded, linear
  The letter "N" stands for the stem II region of a HH ribozyme.
caaauuagcugaugangaaagauacgu

SEQ ID NO: 1456 - DNA, 27 bp; single-stranded, linear
  The letter "N" stands for the stem II region of a HH ribozyme.
ccucaaaucugaugangaaaggagaua

SEQ ID NO: 1457 - DNA, 27 bp; single-stranded, linear
  The letter "N" stands for the stem II region of a HH ribozyme.
gagccucacugaugangaaauuaggag

SEQ ID NO: 1458 - DNA, 27 bp; single-stranded, linear
  The letter "N" stands for the stem II region of a HH ribozyme.
ugagccuccugaugangaaaauuagga

SEQ ID NO: 1459 - DNA, 27 bp; single-stranded, linear
  The letter "N" stands for the stem II region of a HH ribozyme.
uuucaucucugaugangaaagccucaa

SEQ ID NO: 1460 - DNA, 27 bp; single-stranded, linear
  The letter "N" stands for the stem II region of a HH ribozyme.
aaggaccucugaugangaaaugcauuu

SEQ ID NO: 1461 - DNA, 27 bp; single-stranded, linear
  The letter "N" stands for the stem II region of a HH ribozyme.
ccccaaagcugaugangaaaccugaug

SEQ ID NO: 1462 - DNA, 27 bp; single-stranded, linear
  The letter "N" stands for the stem II region of a HH ribozyme.
augccccacugaugangaaaggaccug

SEQ ID NO: 1463 - DNA, 27 bp; single-stranded, linear
  The letter "N" stands for the stem II region of a HH ribozyme.
uaugcccccugaugangaaaaggaccu

SEQ ID NO: 1464 - DNA, 27 bp; single-stranded, linear
  The letter "N" stands for the stem II region of a HH ribozyme.
uucugauccugaugangaaaugcccca

SEQ ID NO: 1465 - DNA, 27 bp; single-stranded, linear
  The letter "N" stands for the stem II region of a HH ribozyme.
agucuucucugaugangaaaucuaugc

SEQ ID NO: 1466 - DNA, 27 bp; single-stranded, linear
  The letter "N" stands for the stem II region of a HH ribozyme.
cauuuuugcugaugangaaagucuucu

SEQ ID NO: 1467 - DNA, 27 bp; single-stranded, linear
  The letter "N" stands for the stem II region of a HH ribozyme.
agauuucacugaugangaaagcagcuu

SEQ ID NO: 1468 - DNA, 27 bp; single-stranded, linear
  The letter "N" stands for the stem II region of a HH ribozyme.
cuaaaggacugaugangaaauuucaga

SEQ ID NO: 1469 - DNA, 27 bp; single-stranded, linear
  The letter "N" stands for the stem II region of a HH ribozyme.
ggcuaaagcugaugangaaagauuuca

SEQ ID NO: 1470 - DNA, 27 bp; single-stranded, linear
  The letter "N" stands for the stem II region of a HH ribozyme.
gauggcuacugaugangaaaggagauu

SEQ ID NO: 1471 - DNA, 27 bp; single-stranded, linear
  The letter "N" stands for the stem II region of a HH ribozyme.
ugauggcucugaugangaaaaggagau

SEQ ID NO: 1472 - DNA, 27 bp; single-stranded, linear
  The letter "N" stands for the stem II region of a HH ribozyme.
gugauggccugaugangaaaaaggaga

SEQ ID NO: 1473 - DNA, 27 bp; single-stranded, linear
  The letter "N" stands for the stem II region of a HH ribozyme.
guuggggucugaugangaaauggcuaa

SEQ ID NO: 1474 - DNA, 27 bp; single-stranded, linear
  The letter "N" stands for the stem II region of a HH ribozyme.
cacaaacucugaugangaaauuuuggg

SEQ ID NO: 1475 - DNA, 27 bp; single-stranded, linear
  The letter "N" stands for the stem II region of a HH ribozyme.
acacaaaccugaugangaaaauuuugg

SEQ ID NO: 1476 - DNA, 27 bp; single-stranded, linear
  The letter "N" stands for the stem II region of a HH ribozyme.
guaacacacugaugangaaacuaauuu

SEQ ID NO: 1477 - DNA, 27 bp; single-stranded, linear
  The letter "N" stands for the stem II region of a HH ribozyme.
aguaacaccugaugangaaaacuaauu

SEQ ID NO: 1478 - DNA, 27 bp; single-stranded, linear
  The letter "N" stands for the stem II region of a HH ribozyme.
ccauaagucugaugangaaacacaaac

SEQ ID NO: 1479 - DNA, 27 bp; single-stranded, linear
  The letter "N" stands for the stem II region of a HH ribozyme.
uccauaagcugaugangaaaacacaaa

SEQ ID NO: 1480 - DNA, 27 bp; single-stranded, linear
  The letter "N" stands for the stem II region of a HH ribozyme.
ucuuccaucugaugangaaaguaacac

SEQ ID NO: 1481 - DNA, 27 bp; single-stranded, linear
  The letter "N" stands for the stem II region of a HH ribozyme.
aucuuccacugaugangaaaaguaaca

SEQ ID NO: 1482 - DNA, 27 bp; single-stranded, linear
  The letter "N" stands for the stem II region of a HH ribozyme.
gagaaaaccugaugangaaaucuucca

SEQ ID NO: 1483 - DNA, 27 bp; single-stranded, linear
  The letter "N" stands for the stem II region of a HH ribozyme.
aaggagaacugaugangaaacuaucuu

SEQ ID NO: 1484 - DNA, 27 bp; single-stranded, linear
  The letter "N" stands for the stem II region of a HH ribozyme.
aaaggagacugaugangaaaacuaucu

SEQ ID NO: 1485 - DNA, 27 bp; single-stranded, linear
  The letter "N" stands for the stem II region of a HH ribozyme.
aaaaggagcugaugangaaaaacuauc

SEQ ID NO: 1486 - DNA, 27 bp; single-stranded, linear
  The letter "N" stands for the stem II region of a HH ribozyme.
uaaaaggacugaugangaaaaaacuau

SEQ ID NO: 1487 - DNA, 27 bp; single-stranded, linear
  The letter "N" stands for the stem II region of a HH ribozyme.
aguaaaagcugaugangaaagaaaacu

SEQ ID NO: 1488 - DNA, 27 bp; single-stranded, linear
  The letter "N" stands for the stem II region of a HH ribozyme.
ugaaguaacugaugangaaaggagaaa

SEQ ID NO: 1489 - DNA, 27 bp; single-stranded, linear
  The letter "N" stands for the stem II region of a HH ribozyme.
gugaaguacugaugangaaaaggagaa

SEQ ID NO: 1490 - DNA, 27 bp; single-stranded, linear
  The letter "N" stands for the stem II region of a HH ribozyme.
agugaagucugaugangaaaaaggaga

SEQ ID NO: 1491 - DNA, 27 bp; single-stranded, linear
  The letter "N" stands for the stem II region of a HH ribozyme.
aagugaagcugaugangaaaaaaggag

SEQ ID NO: 1492 - DNA, 27 bp; single-stranded, linear
  The letter "N" stands for the stem II region of a HH ribozyme.
uugaagugcugaugangaaaguaaaag

SEQ ID NO: 1493 - DNA, 27 bp; single-stranded, linear
  The letter "N" stands for the stem II region of a HH ribozyme.
uuugaagucugaugangaaaaguaaaa

SEQ ID NO: 1494 - DNA, 27 bp; single-stranded, linear
  The letter "N" stands for the stem II region of a HH ribozyme.
agcuuuugcugaugangaaagugaagu

SEQ ID NO: 1495 - DNA, 27 bp; single-stranded, linear
  The letter "N" stands for the stem II region of a HH ribozyme.
aagcuuuucugaugangaaaagugaag

SEQ ID NO: 1496 - DNA, 27 bp; single-stranded, linear
  The letter "N" stands for the stem II region of a HH ribozyme.
ugaguaaacugaugangaaagcuuuug

SEQ ID NO: 1497 - DNA, 27 bp; single-stranded, linear
  The letter "N" stands for the stem II region of a HH ribozyme.
uugaguaacugaugangaaaagcuuuu

SEQ ID NO: 1498 - DNA, 27 bp; single-stranded, linear
  The letter "N" stands for the stem II region of a HH ribozyme.
uuugaguacugaugangaaaaagcuuu

SEQ ID NO: 1499 - DNA, 27 bp; single-stranded, linear
  The letter "N" stands for the stem II region of a HH ribozyme.
cuuugagucugaugangaaaaaagcuu

SEQ ID NO: 1500 - DNA, 27 bp; single-stranded, linear
  The letter "N" stands for the stem II region of a HH ribozyme.
ucuuugagcugaugangaaaaaaagcu

SEQ ID NO: 1501 - DNA, 27 bp; single-stranded, linear
  The letter "N" stands for the stem II region of a HH ribozyme.
uacucuuucugaugangaaaguaaaaa

SEQ ID NO: 1502 - DNA, 27 bp; single-stranded, linear
  The letter "N" stands for the stem II region of a HH ribozyme.
ggaacauacugaugangaaacucuuug

SEQ ID NO: 1503 - DNA, 27 bp; single-stranded, linear
  The letter "N" stands for the stem II region of a HH ribozyme.
agggaacacugaugangaaauacucuu

SEQ ID NO: 1504 - DNA, 27 bp; single-stranded, linear
  The letter "N" stands for the stem II region of a HH ribozyme.
cuggagggcugaugangaaacauauac

SEQ ID NO: 1505 - DNA, 27 bp; single-stranded, linear
  The letter "N" stands for the stem II region of a HH ribozyme.
ccuggaggcugaugangaaaacauaua

SEQ ID NO: 1506 - DNA, 27 bp; single-stranded, linear
  The letter "N" stands for the stem II region of a HH ribozyme.
cugaccugcugaugangaaagggaaca

SEQ ID NO: 1507 - DNA, 27 bp; single-stranded, linear
  The letter "N" stands for the stem II region of a HH ribozyme.
gggcagcucugaugangaaaccuggag

SEQ ID NO: 1508 - DNA, 27 bp; single-stranded, linear
  The letter "N" stands for the stem II region of a HH ribozyme.
agcguaagcugaugangaaaggggguu

SEQ ID NO: 1509 - DNA, 27 bp; single-stranded, linear
  The letter "N" stands for the stem II region of a HH ribozyme.
caaagcgucugaugangaaaggagggg

SEQ ID NO: 1510 - DNA, 27 bp; single-stranded, linear
  The letter "N" stands for the stem II region of a HH ribozyme.
acaaagcgcugaugangaaaaggaggg

SEQ ID NO: 1511 - DNA, 27 bp; single-stranded, linear
  The letter "N" stands for the stem II region of a HH ribozyme.
gugugacacugaugangaaagcguaag

SEQ ID NO: 1512 - DNA, 27 bp; single-stranded, linear
  The letter "N" stands for the stem II region of a HH ribozyme.
ugugugaccugaugangaaaagcguaa

SEQ ID NO: 1513 - DNA, 27 bp; single-stranded, linear
  The letter "N" stands for the stem II region of a HH ribozyme.
uuuugugucugaugangaaacaaagcg

SEQ ID NO: 1514 - DNA, 27 bp; single-stranded, linear
  The letter "N" stands for the stem II region of a HH ribozyme.
aaggcagacugaugangaaacacuuuu

SEQ ID NO: 1515 - DNA, 27 bp; single-stranded, linear
  The letter "N" stands for the stem II region of a HH ribozyme.
ucaaggcacugaugangaaagacacuu

SEQ ID NO: 1516 - DNA, 27 bp; single-stranded, linear
  The letter "N" stands for the stem II region of a HH ribozyme.
gaugacuccugaugangaaaggcagag

SEQ ID NO: 1517 - DNA, 27 bp; single-stranded, linear
  The letter "N" stands for the stem II region of a HH ribozyme.
gaauagaucugaugangaaacucaagg

SEQ ID NO: 1518 - DNA, 27 bp; single-stranded, linear
  The letter "N" stands for the stem II region of a HH ribozyme.
cuugaauacugaugangaaaugacuca

SEQ ID NO: 1519 - DNA, 27 bp; single-stranded, linear
  The letter "N" stands for the stem II region of a HH ribozyme.
ugcuugaacugaugangaaagaugacu

SEQ ID NO: 1520 - DNA, 27 bp; single-stranded, linear
  The letter "N" stands for the stem II region of a HH ribozyme.
agugcuugcugaugangaaauagauga

SEQ ID NO: 1521 - DNA, 27 bp; single-stranded, linear
  The letter "N" stands for the stem II region of a HH ribozyme.
aagugcuucugaugangaaaauagaug

SEQ ID NO: 1522 - DNA, 27 bp; single-stranded, linear
  The letter "N" stands for the stem II region of a HH ribozyme.
agagcugucugaugangaaagugcuug

SEQ ID NO: 1523 - DNA, 27 bp; single-stranded, linear
  The letter "N" stands for the stem II region of a HH ribozyme.
cagagcugcugaugangaaaagugcuu

SEQ ID NO: 1524 - DNA, 27 bp; single-stranded, linear
  The letter "N" stands for the stem II region of a HH ribozyme.
uguggccacugaugangaaagcuguaa

SEQ ID NO: 1525 - DNA, 27 bp; single-stranded, linear
  The letter "N" stands for the stem II region of a HH ribozyme.
accuguaacugaugangaaaugcccug

SEQ ID NO: 1526 - DNA, 27 bp; single-stranded, linear
  The letter "N" stands for the stem II region of a HH ribozyme.
caccuguacugaugangaaaaugcccu

SEQ ID NO: 1527 - DNA, 27 bp; single-stranded, linear
  The letter "N" stands for the stem II region of a HH ribozyme.
gcaccugucugaugangaaaaaugccc

SEQ ID NO: 1528 - DNA, 27 bp; single-stranded, linear
  The letter "N" stands for the stem II region of a HH ribozyme.
cgcaccugcugaugangaaaaaaugcc

SEQ ID NO: 1529 - DNA, 27 bp; single-stranded, linear
  The letter "N" stands for the stem II region of a HH ribozyme.
cauaaugccugaugangaaacugucau

SEQ ID NO: 1530 - DNA, 27 bp; single-stranded, linear
  The letter "N" stands for the stem II region of a HH ribozyme.
cuacucaucugaugangaaaugcuacu

SEQ ID NO: 1531 - DNA, 27 bp; single-stranded, linear
  The letter "N" stands for the stem II region of a HH ribozyme.
acuacucacugaugangaaaaugcuac

SEQ ID NO: 1532 - DNA, 27 bp; single-stranded, linear
  The letter "N" stands for the stem II region of a HH ribozyme.
auucacaccugaugangaaacucauaa

SEQ ID NO: 1533 - DNA, 27 bp; single-stranded, linear
  The letter "N" stands for the stem II region of a HH ribozyme.
acuaccugcugaugangaaauucacac

SEQ ID NO: 1534 - DNA, 27 bp; single-stranded, linear
  The letter "N" stands for the stem II region of a HH ribozyme.
uacuaccucugaugangaaaauucaca

SEQ ID NO: 1535 - DNA, 27 bp; single-stranded, linear
  The letter "N" stands for the stem II region of a HH ribozyme.
auauuuaccugaugangaaaccugaau

SEQ ID NO: 1536 - DNA, 27 bp; single-stranded, linear
  The letter "N" stands for the stem II region of a HH ribozyme.
uucauauucugaugangaaacuaccug

SEQ ID NO: 1537 - DNA, 27 bp; single-stranded, linear
  The letter "N" stands for the stem II region of a HH ribozyme.
uaguuucacugaugangaaauuuacua

SEQ ID NO: 1538 - DNA, 27 bp; single-stranded, linear
  The letter "N" stands for the stem II region of a HH ribozyme.
ucaaaccccugaugangaaaguuucau

SEQ ID NO: 1539 - DNA, 27 bp; single-stranded, linear
  The letter "N" stands for the stem II region of a HH ribozyme.
caauuucacugaugangaaacccuagu

SEQ ID NO: 1540 - DNA, 27 bp; single-stranded, linear
  The letter "N" stands for the stem II region of a HH ribozyme.
ucaauuuccugaugangaaaacccuag

SEQ ID NO: 1541 - DNA, 27 bp; single-stranded, linear
  The letter "N" stands for the stem II region of a HH ribozyme.
gcauuauccugaugangaaauuucaaa

SEQ ID NO: 1542 - DNA, 27 bp; single-stranded, linear
  The letter "N" stands for the stem II region of a HH ribozyme.
gaaagcaucugaugangaaaucaauuu

SEQ ID NO: 1543 - DNA, 27 bp; single-stranded, linear
  The letter "N" stands for the stem II region of a HH ribozyme.
uguugugacugaugangaaagcauuau

SEQ ID NO: 1544 - DNA, 27 bp; single-stranded, linear
  The letter "N" stands for the stem II region of a HH ribozyme.
auguugugcugaugangaaaagcauua

SEQ ID NO: 1545 - DNA, 27 bp; single-stranded, linear
  The letter "N" stands for the stem II region of a HH ribozyme.
aauguugucugaugangaaaaagcauu

SEQ ID NO: 1546 - DNA, 27 bp; single-stranded, linear
  The letter "N" stands for the stem II region of a HH ribozyme.
caucugcacugaugangaaauguugug

SEQ ID NO: 1547 - DNA, 27 bp; single-stranded, linear
  The letter "N" stands for the stem II region of a HH ribozyme.
acaucugccugaugangaaaauguugu

SEQ ID NO: 1548 - DNA, 27 bp; single-stranded, linear
  The letter "N" stands for the stem II region of a HH ribozyme.
ccuucuaacugaugangaaacaucugc

SEQ ID NO: 1549 - DNA, 27 bp; single-stranded, linear
  The letter "N" stands for the stem II region of a HH ribozyme.
uccuucuacugaugangaaaacaucug

SEQ ID NO: 1550 - DNA, 27 bp; single-stranded, linear
  The letter "N" stands for the stem II region of a HH ribozyme.
uuccuucucugaugangaaaaacaucu

SEQ ID NO: 1551 - DNA, 27 bp; single-stranded, linear
  The letter "N" stands for the stem II region of a HH ribozyme.
uuuccuuccugaugangaaaaaacauc

SEQ ID NO: 1552 - DNA, 27 bp; single-stranded, linear
  The letter "N" stands for the stem II region of a HH ribozyme.
uaggaaggcugaugangaaacuuuuuu

SEQ ID NO: 1553 - DNA, 27 bp; single-stranded, linear
  The letter "N" stands for the stem II region of a HH ribozyme.
uuaggaagcugaugangaaaacuuuuu

SEQ ID NO: 1554 - DNA, 27 bp; single-stranded, linear
  The letter "N" stands for the stem II region of a HH ribozyme.
auuuuaggcugaugangaaaggaacuu

SEQ ID NO: 1555 - DNA, 27 bp; single-stranded, linear
  The letter "N" stands for the stem II region of a HH ribozyme.
uauuuuagcugaugangaaaaggaacu

SEQ ID NO: 1556 - DNA, 27 bp; single-stranded, linear
  The letter "N" stands for the stem II region of a HH ribozyme.
aauuauuucugaugangaaaggaagga

SEQ ID NO: 1557 - DNA, 27 bp; single-stranded, linear
  The letter "N" stands for the stem II region of a HH ribozyme.
agagaaaucugaugangaaauuuuagg

SEQ ID NO: 1558 - DNA, 27 bp; single-stranded, linear
  The letter "N" stands for the stem II region of a HH ribozyme.
uguagagacugaugangaaauuauuuu

SEQ ID NO: 1559 - DNA, 27 bp; single-stranded, linear
  The letter "N" stands for the stem II region of a HH ribozyme.
uuguagagcugaugangaaaauuauuu

SEQ ID NO: 1560 - DNA, 27 bp; single-stranded, linear
  The letter "N" stands for the stem II region of a HH ribozyme.
auuguagacugaugangaaaaauuauu

SEQ ID NO: 1561 - DNA, 27 bp; single-stranded, linear
  The letter "N" stands for the stem II region of a HH ribozyme.
caauuguacugaugangaaagaaauua

SEQ ID NO: 1562 - DNA, 27 bp; single-stranded, linear
  The letter "N" stands for the stem II region of a HH ribozyme.
uccaauugcugaugangaaagagaaau

SEQ ID NO: 1563 - DNA, 27 bp; single-stranded, linear
  The letter "N" stands for the stem II region of a HH ribozyme.
aaucuucccugaugangaaauuguaga

SEQ ID NO: 1564 - DNA, 27 bp; single-stranded, linear
  The letter "N" stands for the stem II region of a HH ribozyme.
aaucuucccugaugangaaaucuucca

SEQ ID NO: 1565 - DNA, 27 bp; single-stranded, linear
  The letter "N" stands for the stem II region of a HH ribozyme.
acuagcugcugaugangaaaucuucca

SEQ ID NO: 1566 - DNA, 27 bp; single-stranded, linear
  The letter "N" stands for the stem II region of a HH ribozyme.
aacuagcucugaugangaaaaucuucc

SEQ ID NO: 1567 - DNA, 27 bp; single-stranded, linear
  The letter "N" stands for the stem II region of a HH ribozyme.
cuccuaaccugaugangaaagcugaau

SEQ ID NO: 1568 - DNA, 27 bp; single-stranded, linear
  The letter "N" stands for the stem II region of a HH ribozyme.
gggcuccucugaugangaaacuagcug

SEQ ID NO: 1569 - DNA, 27 bp; single-stranded, linear
  The letter "N" stands for the stem II region of a HH ribozyme.
ugggcucccugaugangaaaacuagcu

SEQ ID NO: 1570 - DNA, 27 bp; single-stranded, linear
  The letter "N" stands for the stem II region of a HH ribozyme.
uaggaaaacugaugangaaaugggcuc

SEQ ID NO: 1571 - DNA, 27 bp; single-stranded, linear
  The letter "N" stands for the stem II region of a HH ribozyme.
uuaggaaacugaugangaaaaugggcu

SEQ ID NO: 1572 - DNA, 27 bp; single-stranded, linear
  The letter "N" stands for the stem II region of a HH ribozyme.
auuaggaacugaugangaaaaaugggc

SEQ ID NO: 1573 - DNA, 27 bp; single-stranded, linear
  The letter "N" stands for the stem II region of a HH ribozyme.
gauuaggacugaugangaaaaaauggg

SEQ ID NO: 1574 - DNA, 27 bp; single-stranded, linear
  The letter "N" stands for the stem II region of a HH ribozyme.
agauuaggcugaugangaaaaaaaugg

SEQ ID NO: 1575 - DNA, 27 bp; single-stranded, linear
  The letter "N" stands for the stem II region of a HH ribozyme.
cagauuagcugaugangaaaaaaaaug

SEQ ID NO: 1576 - DNA, 27 bp; single-stranded, linear
  The letter "N" stands for the stem II region of a HH ribozyme.
acacagaucugaugangaaaggaaaaa

SEQ ID NO: 1577 - DNA, 27 bp; single-stranded, linear
  The letter "N" stands for the stem II region of a HH ribozyme.
cacacacacugaugangaaauuaggaa

SEQ ID NO: 1578 - DNA, 27 bp; single-stranded, linear
  The letter "N" stands for the stem II region of a HH ribozyme.
agucaggucugaugangaaacagggca

SEQ ID NO: 1579 - DNA, 27 bp; single-stranded, linear
  The letter "N" stands for the stem II region of a HH ribozyme.
cugcuguucugaugangaaaccaguca

SEQ ID NO: 1580 - DNA, 27 bp; single-stranded, linear
  The letter "N" stands for the stem II region of a HH ribozyme.
acugcugucugaugangaaaaccaguc

SEQ ID NO: 1581 - DNA, 27 bp; single-stranded, linear
  The letter "N" stands for the stem II region of a HH ribozyme.
uuacaaagcugaugangaaacugcugu

SEQ ID NO: 1582 - DNA, 27 bp; single-stranded, linear
  The letter "N" stands for the stem II region of a HH ribozyme.
uguuuacacugaugangaaaggacugc

SEQ ID NO: 1583 - DNA, 27 bp; single-stranded, linear
  The letter "N" stands for the stem II region of a HH ribozyme.
cuguuuaccugaugangaaaaggacug

SEQ ID NO: 1584 - DNA, 27 bp; single-stranded, linear
  The letter "N" stands for the stem II region of a HH ribozyme.
acacuguucugaugangaaacaaagga

SEQ ID NO: 1585 - DNA, 27 bp; single-stranded, linear
  The letter "N" stands for the stem II region of a HH ribozyme.
gaguuuaacugaugangaaacacuguu

SEQ ID NO: 1586 - DNA, 27 bp; single-stranded, linear
  The letter "N" stands for the stem II region of a HH ribozyme.
agaguuuacugaugangaaaacacugu

SEQ ID NO: 1587 - DNA, 27 bp; single-stranded, linear
  The letter "N" stands for the stem II region of a HH ribozyme.
gagaguuucugaugangaaaaacacug

SEQ ID NO: 1588 - DNA, 27 bp; single-stranded, linear
  The letter "N" stands for the stem II region of a HH ribozyme.
ggagaguucugaugangaaaaaacacu

SEQ ID NO: 1589 - DNA, 27 bp; single-stranded, linear
  The letter "N" stands for the stem II region of a HH ribozyme.
gacuaggacugaugangaaaguuuaaa

SEQ ID NO: 1590 - DNA, 27 bp; single-stranded, linear
  The letter "N" stands for the stem II region of a HH ribozyme.
uugacuagcugaugangaaagaguuua

SEQ ID NO: 1591 - DNA, 27 bp; single-stranded, linear
  The letter "N" stands for the stem II region of a HH ribozyme.
auauugaccugaugangaaaggagagu

SEQ ID NO: 1592 - DNA, 27 bp; single-stranded, linear
  The letter "N" stands for the stem II region of a HH ribozyme.
uggauauucugaugangaaacuaggag

SEQ ID NO: 1593 - DNA, 27 bp; single-stranded, linear
  The letter "N" stands for the stem II region of a HH ribozyme.
gggguggacugaugangaaauugacua

SEQ ID NO: 1594 - DNA, 27 bp; single-stranded, linear
  The letter "N" stands for the stem II region of a HH ribozyme.
auggggugcugaugangaaauauugac

SEQ ID NO: 1595 - DNA, 27 bp; single-stranded, linear
  The letter "N" stands for the stem II region of a HH ribozyme.
auaaauugcugaugangaaauggggug

SEQ ID NO: 1596 - DNA, 27 bp; single-stranded, linear
  The letter "N" stands for the stem II region of a HH ribozyme.
ccuugauacugaugangaaauuggaug

SEQ ID NO: 1597 - DNA, 27 bp; single-stranded, linear
  The letter "N" stands for the stem II region of a HH ribozyme.
uccuugaucugaugangaaaauuggau

SEQ ID NO: 1598 - DNA, 27 bp; single-stranded, linear
  The letter "N" stands for the stem II region of a HH ribozyme.
uuccuugacugaugangaaaaauugga

SEQ ID NO: 1599 - DNA, 27 bp; single-stranded, linear
  The letter "N" stands for the stem II region of a HH ribozyme.
ucuuccuucugaugangaaauaaauug

SEQ ID NO: 1600 - DNA, 27 bp; single-stranded, linear
  The letter "N" stands for the stem II region of a HH ribozyme.
auuuucugcugaugangaaaccauuuc

SEQ ID NO: 1601 - DNA, 27 bp; single-stranded, linear
  The letter "N" stands for the stem II region of a HH ribozyme.
uauuuucucugaugangaaaaccauuu

SEQ ID NO: 1602 - DNA, 27 bp; single-stranded, linear
  The letter "N" stands for the stem II region of a HH ribozyme.
gcugaaaacugaugangaaauuuucug

SEQ ID NO: 1603 - DNA, 27 bp; single-stranded, linear
  The letter "N" stands for the stem II region of a HH ribozyme.
aggcugaacugaugangaaauauuuuc

SEQ ID NO: 1604 - DNA, 27 bp; single-stranded, linear
  The letter "N" stands for the stem II region of a HH ribozyme.
uaggcugacugaugangaaaauauuuu

SEQ ID NO: 1605 - DNA, 27 bp; single-stranded, linear
  The letter "N" stands for the stem II region of a HH ribozyme.
guaggcugcugaugangaaaaauauuu

SEQ ID NO: 1606 - DNA, 27 bp; single-stranded, linear
  The letter "N" stands for the stem II region of a HH ribozyme.
uguaggcucugaugangaaaaaauauu

SEQ ID NO: 1607 - DNA, 27 bp; single-stranded, linear
  The letter "N" stands for the stem II region of a HH ribozyme.
cauaacugcugaugangaaaggcugaa

SEQ ID NO: 1608 - DNA, 27 bp; single-stranded, linear
  The letter "N" stands for the stem II region of a HH ribozyme.
cugaacaucugaugangaaacuguagg

SEQ ID NO: 1609 - DNA, 27 bp; single-stranded, linear
  The letter "N" stands for the stem II region of a HH ribozyme.
acugaacacugaugangaaaacuguag

SEQ ID NO: 1610 - DNA, 27 bp; single-stranded, linear
  The letter "N" stands for the stem II region of a HH ribozyme.
ugugacugcugaugangaaacauaacu

SEQ ID NO: 1611 - DNA, 27 bp; single-stranded, linear
  The letter "N" stands for the stem II region of a HH ribozyme.
gugugacucugaugangaaaacauaac

SEQ ID NO: 1612 - DNA, 27 bp; single-stranded, linear
  The letter "N" stands for the stem II region of a HH ribozyme.
gugugugucugaugangaaacugaaca

SEQ ID NO: 1613 - DNA, 27 bp; single-stranded, linear
  The letter "N" stands for the stem II region of a HH ribozyme.
acauuuugcugaugangaaaugugugu

SEQ ID NO: 1614 - DNA, 27 bp; single-stranded, linear
  The letter "N" stands for the stem II region of a HH ribozyme.
gcaaaaggcugaugangaaacauuuug

SEQ ID NO: 1615 - DNA, 27 bp; single-stranded, linear
  The letter "N" stands for the stem II region of a HH ribozyme.
agcaaaagcugaugangaaaacauuuu

SEQ ID NO: 1616 - DNA, 27 bp; single-stranded, linear
  The letter "N" stands for the stem II region of a HH ribozyme.
aaaagcaacugaugangaaaggaacau

SEQ ID NO: 1617 - DNA, 27 bp; single-stranded, linear
  The letter "N" stands for the stem II region of a HH ribozyme.
uaaaagcacugaugangaaaaggaaca

SEQ ID NO: 1618 - DNA, 27 bp; single-stranded, linear
  The letter "N" stands for the stem II region of a HH ribozyme.
uuaaaagccugaugangaaaaaggaac

SEQ ID NO: 1619 - DNA, 27 bp; single-stranded, linear
  The letter "N" stands for the stem II region of a HH ribozyme.
uacuuuaacugaugangaaagcaaaag

SEQ ID NO: 1620 - DNA, 27 bp; single-stranded, linear
  The letter "N" stands for the stem II region of a HH ribozyme.
uuacuuuacugaugangaaaagcaaaa

SEQ ID NO: 1621 - DNA, 27 bp; single-stranded, linear
  The letter "N" stands for the stem II region of a HH ribozyme.
auuacuuucugaugangaaaaagcaaa

SEQ ID NO: 1622 - DNA, 27 bp; single-stranded, linear
  The letter "N" stands for the stem II region of a HH ribozyme.
aauuacuucugaugangaaaaaagcaa

SEQ ID NO: 1623 - DNA, 27 bp; single-stranded, linear
  The letter "N" stands for the stem II region of a HH ribozyme.
ucaaaaaucugaugangaaacuuuaaa

SEQ ID NO: 1624 - DNA, 27 bp; single-stranded, linear
  The letter "N" stands for the stem II region of a HH ribozyme.
gagucaaacugaugangaaauuacuuu

SEQ ID NO: 1625 - DNA, 27 bp; single-stranded, linear
  The letter "N" stands for the stem II region of a HH ribozyme.
ggagucaacugaugangaaaauuacuu

SEQ ID NO: 1626 - DNA, 27 bp; single-stranded, linear
  The letter "N" stands for the stem II region of a HH ribozyme.
gggagucacugaugangaaaaauuacu

SEQ ID NO: 1627 - DNA, 27 bp; single-stranded, linear
  The letter "N" stands for the stem II region of a HH ribozyme.
ugggaguccugaugangaaaaaauuac

SEQ ID NO: 1628 - DNA, 27 bp; single-stranded, linear
  The letter "N" stands for the stem II region of a HH ribozyme.
ugaucuggcugaugangaaagucaaaa

SEQ ID NO: 1629 - DNA, 27 bp; single-stranded, linear
  The letter "N" stands for the stem II region of a HH ribozyme.
cucugacucugaugangaaaucuggga

SEQ ID NO: 1630 - DNA, 27 bp; single-stranded, linear
  The letter "N" stands for the stem II region of a HH ribozyme.
ggggcucucugaugangaaacugaucu

SEQ ID NO: 1631 - DNA, 27 bp; single-stranded, linear
  The letter "N" stands for the stem II region of a HH ribozyme.
caaugcugcugaugangaaaggggcuc

SEQ ID NO: 1632 - DNA, 27 bp; single-stranded, linear
  The letter "N" stands for the stem II region of a HH ribozyme.
uucuuaaccugaugangaaaugcugua

SEQ ID NO: 1633 - DNA, 27 bp; single-stranded, linear
  The letter "N" stands for the stem II region of a HH ribozyme.
acuuucuucugaugangaaacaaugcu

SEQ ID NO: 1634 - DNA, 27 bp; single-stranded, linear
  The letter "N" stands for the stem II region of a HH ribozyme.
uacuuucucugaugangaaaacaaugc

SEQ ID NO: 1635 - DNA, 27 bp; single-stranded, linear
  The letter "N" stands for the stem II region of a HH ribozyme.
  The letter "N" stands for the stem II region of a HH ribozyme.
aaaucaaacugaugangaaacuuucuu

SEQ ID NO: 1636 - DNA, 27 bp; single-stranded, linear
  The letter "N" stands for the stem II region of a HH ribozyme.
  The letter "N" stands for the stem II region of a HH ribozyme.
aaaaaucacugaugangaaauacuuuc

SEQ ID NO: 1637 - DNA, 27 bp; single-stranded, linear
  The letter "N" stands for the stem II region of a HH ribozyme.
caaaaauccugaugangaaaauacuuu

SEQ ID NO: 1638 - DNA, 27 bp; single-stranded, linear
  The letter "N" stands for the stem II region of a HH ribozyme.
gagacaaacugaugangaaaucaaaua

SEQ ID NO: 1639 - DNA, 27 bp; single-stranded, linear
  The letter "N" stands for the stem II region of a HH ribozyme.
ugagacaacugaugangaaaaucaaau

SEQ ID NO: 1640 - DNA, 27 bp; single-stranded, linear
  The letter "N" stands for the stem II region of a HH ribozyme.
uugagacacugaugangaaaaaucaaa

SEQ ID NO: 1641 - DNA, 27 bp; single-stranded, linear
  The letter "N" stands for the stem II region of a HH ribozyme.
auugagaccugaugangaaaaaaucaa

SEQ ID NO: 1642 - DNA, 27 bp; single-stranded, linear
  The letter "N" stands for the stem II region of a HH ribozyme.
uucauugacugaugangaaacaaaaau

SEQ ID NO: 1643 - DNA, 27 bp; single-stranded, linear
  The letter "N" stands for the stem II region of a HH ribozyme.
uuuucauucugaugangaaagacaaaa

SEQ ID NO: 1644 - DNA, 27 bp; single-stranded, linear
  The letter "N" stands for the stem II region of a HH ribozyme.
uauaguuucugaugangaaauuuucau

SEQ ID NO: 1645 - DNA, 27 bp; single-stranded, linear
  The letter "N" stands for the stem II region of a HH ribozyme.
aaugaauacugaugangaaaguuuuau

SEQ ID NO: 1646 - DNA, 27 bp; single-stranded, linear
  The letter "N" stands for the stem II region of a HH ribozyme.
gaaaugaacugaugangaaauaguuuu

SEQ ID NO: 1647 - DNA, 50 bp; single-stranded, linear
ggcggcagaagcgcaccagagaaacacacguugugguacauuaccuggua

SEQ ID NO: 1648 - DNA, 50 bp; single-stranded, linear
cugggcagaagcggaccagagaaacacacguugugguacauuaccuggua

SEQ ID NO: 1649 - DNA, 50 bp; single-stranded, linear
ggucugagaagcggaccagagaaacacacguugugguacauuaccuggua

SEQ ID NO: 1650 - DNA, 50 bp; single-stranded, linear
cguccgagaagggcaccagagaaacacacguugugguacauuaccuggua

SEQ ID NO: 1651 - DNA, 50 bp; single-stranded, linear
ccugucagaaggucaccagagaaacacacguugugguacauuaccuggua

SEQ ID NO: 1652 - DNA, 50 bp; single-stranded, linear
gacucgagaagacgaccagagaaacacacguugugguacauuaccuggua

SEQ ID NO: 1653 - DNA, 50 bp; single-stranded, linear
cggcgaagaagggaaccagagaaacacacguugugguacauuaccuggua

SEQ ID NO: 1654 - DNA, 50 bp; single-stranded, linear
ucagggagaagugcaccagagaaacacacguugugguacauuaccuggua

SEQ ID NO: 1655 - DNA, 50 bp; single-stranded, linear
gacggaagaaggggaccagagaaacacacguugugguacauuaccuggua

SEQ ID NO: 1656 - DNA, 50 bp; single-stranded, linear
auacugagaagaguaccagagaaacacacguugugguacauuaccuggua

SEQ ID NO: 1657 - DNA, 50 bp; single-stranded, linear
ugccccagaaguccaccagagaaacacacguugugguacauuaccuggua

SEQ ID NO: 1658 - DNA, 50 bp; single-stranded, linear
gcagccagaagcgcaccagagaaacacacguugugguacauuaccuggua

SEQ ID NO: 1659 - DNA, 50 bp; single-stranded, linear
ucgccgagaagagcaccagagaaacacacguugugguacauuaccuggua

SEQ ID NO: 1660 - DNA, 50 bp; single-stranded, linear
gugcccagaagcguaccagagaaacacacguugugguacauuaccuggua

SEQ ID NO: 1661 - DNA, 50 bp; single-stranded, linear
ucuggaagaagagaaccagagaaacacacguugugguacauuaccuggua

SEQ ID NO: 1662 - DNA, 50 bp; single-stranded, linear
cugaugagaagcagaccagagaaacacacguugugguacauuaccuggua

SEQ ID NO: 1663 - DNA, 50 bp; single-stranded, linear
agauaaagaagcuaaccagagaaacacacguugugguacauuaccuggua

SEQ ID NO: 1664 - DNA, 50 bp; single-stranded, linear
ccuucaagaagguuaccagagaaacacacguugugguacauuaccuggua

SEQ ID NO: 1665 - DNA, 50 bp; single-stranded, linear
cucaugagaagcucaccagagaaacacacguugugguacauuaccuggua

SEQ ID NO: 1666 - DNA, 50 bp; single-stranded, linear
uugcugagaagcacaccagagaaacacacguugugguacauuaccuggua

SEQ ID NO: 1667 - DNA, 50 bp; single-stranded, linear
gcacagagaaggguaccagagaaacacacguugugguacauuaccuggua

SEQ ID NO: 1668 - DNA, 50 bp; single-stranded, linear
uuuggcagaagcccaccagagaaacacacguugugguacauuaccuggua

SEQ ID NO: 1669 - DNA, 50 bp; single-stranded, linear
cauuggagaagcuuaccagagaaacacacguugugguacauuaccuggua

SEQ ID NO: 1670 - DNA, 50 bp; single-stranded, linear
caccccagaagcucaccagagaaacacacguugugguacauuaccuggua

SEQ ID NO: 1671 - DNA, 50 bp; single-stranded, linear
auuuugagaaguuuaccagagaaacacacguugugguacauuaccuggua

SEQ ID NO: 1672 - DNA, 50 bp; single-stranded, linear
ugccacagaagcgcaccagagaaacacacguugugguacauuaccuggua

SEQ ID NO: 1673 - DNA, 50 bp; single-stranded, linear
uguggcagaagucaaccagagaaacacacguugugguacauuaccuggua

SEQ ID NO: 1674 - DNA, 50 bp; single-stranded, linear
agaccaagaagucgaccagagaaacacacguugugguacauuaccuggua

SEQ ID NO: 1675 - DNA, 50 bp; single-stranded, linear
auuugcagaagaccaccagagaaacacacguugugguacauuaccuggua

SEQ ID NO: 1676 - DNA, 50 bp; single-stranded, linear
guggggagaaggugaccagagaaacacacguugugguacauuaccuggua

SEQ ID NO: 1677 - DNA, 50 bp; single-stranded, linear
acauccagaagguaaccagagaaacacacguugugguacauuaccuggua

SEQ ID NO: 1678 - DNA, 50 bp; single-stranded, linear
caccaaagaaguauaccagagaaacacacguugugguacauuaccuggua

SEQ ID NO: 1679 - DNA, 50 bp; single-stranded, linear
gccgugagaagucaaccagagaaacacacguugugguacauuaccuggua

SEQ ID NO: 1680 - DNA, 50 bp; single-stranded, linear
cgcacgagaagugaaccagagaaacacacguugugguacauuaccuggua

SEQ ID NO: 1681 - DNA, 50 bp; single-stranded, linear
gccaccagaaggauaccagagaaacacacguugugguacauuaccuggua

SEQ ID NO: 1682 - DNA, 50 bp; single-stranded, linear
gccugaagaagcaaaccagagaaacacacguugugguacauuaccuggua

SEQ ID NO: 1683 - DNA, 50 bp; single-stranded, linear
auggagagaaguccaccagagaaacacacguugugguacauuaccuggua

SEQ ID NO: 1684 - DNA, 50 bp; single-stranded, linear
agagaaagaagaccaccagagaaacacacguugugguacauuaccuggua

SEQ ID NO: 1685 - DNA, 50 bp; single-stranded, linear
gcugacagaagcaaaccagagaaacacacguugugguacauuaccuggua

SEQ ID NO: 1686 - DNA, 50 bp; single-stranded, linear
uguucaagaagacgaccagagaaacacacguugugguacauuaccuggua

SEQ ID NO: 1687 - DNA, 50 bp; single-stranded, linear
gucccaagaaguuuaccagagaaacacacguugugguacauuaccuggua

SEQ ID NO: 1688 - DNA, 50 bp; single-stranded, linear
ccuugcagaaguuuaccagagaaacacacguugugguacauuaccuggua

SEQ ID NO: 1689 - DNA, 50 bp; single-stranded, linear
ggccccagaagcccaccagagaaacacacguugugguacauuaccuggua

SEQ ID NO: 1690 - DNA, 50 bp; single-stranded, linear
ugccucagaagacaaccagagaaacacacguugugguacauuaccuggua

SEQ ID NO: 1691 - DNA, 50 bp; single-stranded, linear
gccugaagaaggcaaccagagaaacacacguugugguacauuaccuggua

SEQ ID NO: 1692 - DNA, 50 bp; single-stranded, linear
agugggagaagucaaccagagaaacacacguugugguacauuaccuggua

SEQ ID NO: 1693 - DNA, 50 bp; single-stranded, linear
cugccgagaaggucaccagagaaacacacguugugguacauuaccuggua

SEQ ID NO: 1694 - DNA, 50 bp; single-stranded, linear
gccggcagaagcguaccagagaaacacacguugugguacauuaccuggua

SEQ ID NO: 1695 - DNA, 50 bp; single-stranded, linear
cagugcagaaguagaccagagaaacacacguugugguacauuaccuggua

SEQ ID NO: 1696 - DNA, 50 bp; single-stranded, linear
ucguugagaagccuaccagagaaacacacguugugguacauuaccuggua

SEQ ID NO: 1697 - DNA, 50 bp; single-stranded, linear
gcgaugagaaggauaccagagaaacacacguugugguacauuaccuggua

SEQ ID NO: 1698 - DNA, 50 bp; single-stranded, linear
accaccagaagcaaaccagagaaacacacguugugguacauuaccuggua

SEQ ID NO: 1699 - DNA, 50 bp; single-stranded, linear
ugaagaagaagaucaccagagaaacacacguugugguacauuaccuggua

SEQ ID NO: 1700 - DNA, 50 bp; single-stranded, linear
uccugcagaagccuaccagagaaacacacguugugguacauuaccuggua

SEQ ID NO: 1701 - DNA, 50 bp; single-stranded, linear
gauagcagaaggaaaccagagaaacacacguugugguacauuaccuggua

SEQ ID NO: 1702 - DNA, 50 bp; single-stranded, linear
ccagcaagaagcacaccagagaaacacacguugugguacauuaccuggua

SEQ ID NO: 1703 - DNA, 50 bp; single-stranded, linear
augcccagaaggcgaccagagaaacacacguugugguacauuaccuggua

SEQ ID NO: 1704 - DNA, 50 bp; single-stranded, linear
aggugaagaagaugaccagagaaacacacguugugguacauuaccuggua

SEQ ID NO: 1705 - DNA, 50 bp; single-stranded, linear
ggcaugagaagcguaccagagaaacacacguugugguacauuaccuggua

SEQ ID NO: 1706 - DNA, 50 bp; single-stranded, linear
ggaggcagaagaagaccagagaaacacacguugugguacauuaccuggua

SEQ ID NO: 1707 - DNA, 50 bp; single-stranded, linear
ccaggaagaagccgaccagagaaacacacguugugguacauuaccuggua

SEQ ID NO: 1708 - DNA, 50 bp; single-stranded, linear
caguugagaagguaaccagagaaacacacguugugguacauuaccuggua

SEQ ID NO: 1709 - DNA, 50 bp; single-stranded, linear
uuugcgagaagcacaccagagaaacacacguugugguacauuaccuggua

SEQ ID NO: 1710 - DNA, 50 bp; single-stranded, linear
ccaagcagaaguccaccagagaaacacacguugugguacauuaccuggua

SEQ ID NO: 1711 - DNA, 50 bp; single-stranded, linear
cccaaaagaagugaaccagagaaacacacguugugguacauuaccuggua

SEQ ID NO: 1712 - DNA, 50 bp; single-stranded, linear
gcacccagaaguuuaccagagaaacacacguugugguacauuaccuggua

SEQ ID NO: 1713 - DNA, 50 bp; single-stranded, linear
cucccaagaagucaaccagagaaacacacguugugguacauuaccuggua

SEQ ID NO: 1714 - DNA, 50 bp; single-stranded, linear
guuggaagaaguagaccagagaaacacacguugugguacauuaccuggua

SEQ ID NO: 1715 - DNA, 50 bp; single-stranded, linear
ucauccagaagggcaccagagaaacacacguugugguacauuaccuggua

SEQ ID NO: 1716 - DNA, 50 bp; single-stranded, linear
guacucagaagcauaccagagaaacacacguugugguacauuaccuggua

SEQ ID NO: 1717 - DNA, 50 bp; single-stranded, linear
uggaggagaagcugaccagagaaacacacguugugguacauuaccuggua

SEQ ID NO: 1718 - DNA, 50 bp; single-stranded, linear
aggggaagaagugaaccagagaaacacacguugugguacauuaccuggua

SEQ ID NO: 1719 - DNA, 50 bp; single-stranded, linear
ugauggagaagcuuaccagagaaacacacguugugguacauuaccuggua

SEQ ID NO: 1720 - DNA, 50 bp; single-stranded, linear
gcaagaagaagucuaccagagaaacacacguugugguacauuaccuggua

SEQ ID NO: 1721 - DNA, 50 bp; single-stranded, linear
ggucugagaaguauaccagagaaacacacguugugguacauuaccuggua

SEQ ID NO: 1722 - DNA, 50 bp; single-stranded, linear
ugugggagaagagcaccagagaaacacacguugugguacauuaccuggua

SEQ ID NO: 1723 - DNA, 50 bp; single-stranded, linear
ggaacgagaagguuaccagagaaacacacguugugguacauuaccuggua

SEQ ID NO: 1724 - DNA, 50 bp; single-stranded, linear
uuugggagaagacuaccagagaaacacacguugugguacauuaccuggua

SEQ ID NO: 1725 - DNA, 50 bp; single-stranded, linear
agagccagaaggccaccagagaaacacacguugugguacauuaccuggua

SEQ ID NO: 1726 - DNA, 50 bp; single-stranded, linear
gugauaagaaggauaccagagaaacacacguugugguacauuaccuggua

SEQ ID NO: 1727 - DNA, 50 bp; single-stranded, linear
uucagaagaagauuaccagagaaacacacguugugguacauuaccuggua

SEQ ID NO: 1728 - DNA, 50 bp; single-stranded, linear
gggcugagaaguguaccagagaaacacacguugugguacauuaccuggua

SEQ ID NO: 1729 - DNA, 50 bp; single-stranded, linear
caggugagaaggacaccagagaaacacacguugugguacauuaccuggua

SEQ ID NO: 1730 - DNA, 50 bp; single-stranded, linear
gggcagagaagucgaccagagaaacacacguugugguacauuaccuggua

SEQ ID NO: 1731 - DNA, 50 bp; single-stranded, linear
ccagugagaagggcaccagagaaacacacguugugguacauuaccuggua

SEQ ID NO: 1732 - DNA, 50 bp; single-stranded, linear
cugguaagaaggguaccagagaaacacacguugugguacauuaccuggua

SEQ ID NO: 1733 - DNA, 50 bp; single-stranded, linear
auuuucagaaguggaccagagaaacacacguugugguacauuaccuggua

SEQ ID NO: 1734 - DNA, 50 bp; single-stranded, linear
gaaagaagaaggauaccagagaaacacacguugugguacauuaccuggua

SEQ ID NO: 1735 - DNA, 50 bp; single-stranded, linear
aaaccaagaaguggaccagagaaacacacguugugguacauuaccuggua

SEQ ID NO: 1736 - DNA, 50 bp; single-stranded, linear
uggcuaagaaguguaccagagaaacacacguugugguacauuaccuggua

SEQ ID NO: 1737 - DNA, 50 bp; single-stranded, linear
ccuugaagaagaacaccagagaaacacacguugugguacauuaccuggua

SEQ ID NO: 1738 - DNA, 50 bp; single-stranded, linear
guaccgagaaggccaccagagaaacacacguugugguacauuaccuggua

SEQ ID NO: 1739 - DNA, 50 bp; single-stranded, linear
ggaaggagaagaguaccagagaaacacacguugugguacauuaccuggua

SEQ ID NO: 1740 - DNA, 50 bp; single-stranded, linear
ugguccagaaguggaccagagaaacacacguugugguacauuaccuggua

SEQ ID NO: 1741 - DNA, 50 bp; single-stranded, linear
aaacaaagaagucuaccagagaaacacacguugugguacauuaccuggua

SEQ ID NO: 1742 - DNA, 50 bp; single-stranded, linear
gacaggagaagcauaccagagaaacacacguugugguacauuaccuggua

SEQ ID NO: 1743 - DNA, 50 bp; single-stranded, linear
cagcaaagaaggggaccagagaaacacacguugugguacauuaccuggua

SEQ ID NO: 1744 - DNA, 50 bp; single-stranded, linear
gcuggaagaagaguaccagagaaacacacguugugguacauuaccuggua

SEQ ID NO: 1745 - DNA, 50 bp; single-stranded, linear
aaugugagaaggaaaccagagaaacacacguugugguacauuaccuggua

SEQ ID NO: 1746 - DNA, 50 bp; single-stranded, linear
auucucagaaguggaccagagaaacacacguugugguacauuaccuggua

SEQ ID NO: 1747 - DNA, 50 bp; single-stranded, linear
aacaaaagaaguguaccagagaaacacacguugugguacauuaccuggua

SEQ ID NO: 1748 - DNA, 50 bp; single-stranded, linear
cauuucagaagagcaccagagaaacacacguugugguacauuaccuggua

SEQ ID NO: 1749 - DNA, 50 bp; single-stranded, linear
uuucagagaagcuuaccagagaaacacacguugugguacauuaccuggua

SEQ ID NO: 1750 - DNA, 50 bp; single-stranded, linear
gggggcagaagaccaccagagaaacacacguugugguacauuaccuggua

SEQ ID NO: 1751 - DNA, 50 bp; single-stranded, linear
uuugggagaagcugaccagagaaacacacguugugguacauuaccuggua

SEQ ID NO: 1752 - DNA, 50 bp; single-stranded, linear
acucaaagaagagaaccagagaaacacacguugugguacauuaccuggua

SEQ ID NO: 1753 - DNA, 50 bp; single-stranded, linear
ggccagagaaguaaaccagagaaacacacguugugguacauuaccuggua

SEQ ID NO: 1754 - DNA, 50 bp; single-stranded, linear
uaaaacagaagcaaaccagagaaacacacguugugguacauuaccuggua

SEQ ID NO: 1755 - DNA, 50 bp; single-stranded, linear
uaaccaagaagguuaccagagaaacacacguugugguacauuaccuggua

SEQ ID NO: 1756 - DNA, 50 bp; single-stranded, linear
acaaagagaagcugaccagagaaacacacguugugguacauuaccuggua

SEQ ID NO: 1757 - DNA, 50 bp; single-stranded, linear
acuguaagaagaaaaccagagaaacacacguugugguacauuaccuggua

SEQ ID NO: 1758 - DNA, 50 bp; single-stranded, linear
ugacugagaagggaaccagagaaacacacguugugguacauuaccuggua

SEQ ID NO: 1759 - DNA, 14 bp; single-stranded, linear
gcgccgccgccgcc

SEQ ID NO: 1760 - DNA, 14 bp; single-stranded, linear
ccgccgccgcccag

SEQ ID NO: 1761 - DNA, 14 bp; single-stranded, linear
ccgccgcccagacc

SEQ ID NO: 1762 - DNA, 14 bp; single-stranded, linear
gcccagaccggacg

SEQ ID NO: 1763 - DNA, 14 bp; single-stranded, linear
gaccggacgacagg

SEQ ID NO: 1764 - DNA, 14 bp; single-stranded, linear
cguccgcccgaguc

SEQ ID NO: 1765 - DNA, 14 bp; single-stranded, linear
uccccgccucgccg

SEQ ID NO: 1766 - DNA, 14 bp; single-stranded, linear
gcacggcccccuga

SEQ ID NO: 1767 - DNA, 14 bp; single-stranded, linear
ccccugacuccguc

SEQ ID NO: 1768 - DNA, 14 bp; single-stranded, linear
acuccguccaguau

SEQ ID NO: 1769 - DNA, 14 bp; single-stranded, linear
ggacggccggggca

SEQ ID NO: 1770 - DNA, 14 bp; single-stranded, linear
gcgcugcuggcugc

SEQ ID NO: 1771 - DNA, 14 bp; single-stranded, linear
gcucugcccggcga

SEQ ID NO: 1772 - DNA, 14 bp; single-stranded, linear
acgcaguugggcac

SEQ ID NO: 1773 - DNA, 14 bp; single-stranded, linear
ucucagccuccaga

SEQ ID NO: 1774 - DNA, 14 bp; single-stranded, linear
cugcagaucaucag

SEQ ID NO: 1775 - DNA, 14 bp; single-stranded, linear
uagcagucuuaucu

SEQ ID NO: 1776 - DNA, 14 bp; single-stranded, linear
aaccggacugaagg

SEQ ID NO: 1777 - DNA, 14 bp; single-stranded, linear
gagcugcccaugag

SEQ ID NO: 1778 - DNA, 14 bp; single-stranded, linear
gugcgguucagcaa

SEQ ID NO: 1779 - DNA, 14 bp; single-stranded, linear
acccugcccugugc

SEQ ID NO: 1780 - DNA, 14 bp; single-stranded, linear
gggcagcugccaaa

SEQ ID NO: 1781 - DNA, 14 bp; single-stranded, linear
aagcugucccaaug

SEQ ID NO: 1782 - DNA, 14 bp; single-stranded, linear
gagcugcuggggug

SEQ ID NO: 1783 - DNA, 14 bp; single-stranded, linear
aaacugaccaaaau

SEQ ID NO: 1784 - DNA, 14 bp; single-stranded, linear
gcgcugccguggca

SEQ ID NO: 1785 - DNA, 14 bp; single-stranded, linear
ugacugcugccaca

SEQ ID NO: 1786 - DNA, 14 bp; single-stranded, linear
cgacugccuggucu

SEQ ID NO: 1787 - DNA, 14 bp; single-stranded, linear
ggucugccgcaaau

SEQ ID NO: 1788 - DNA, 14 bp; single-stranded, linear
caccugccccccac

SEQ ID NO: 1789 - DNA, 14 bp; single-stranded, linear
uaccagauggaugu

SEQ ID NO: 1790 - DNA, 14 bp; single-stranded, linear
auacagcuuuggug

SEQ ID NO: 1791 - DNA, 14 bp; single-stranded, linear
ugacagaucacggc

SEQ ID NO: 1792 - DNA, 14 bp; single-stranded, linear
ucacggcucgugcg

SEQ ID NO: 1793 - DNA, 14 bp; single-stranded, linear
auccugccgguggc

SEQ ID NO: 1794 - DNA, 14 bp; single-stranded, linear
uugcugauucaggc

SEQ ID NO: 1795 - DNA, 14 bp; single-stranded, linear
ggacggaccuccau

SEQ ID NO: 1796 - DNA, 14 bp; single-stranded, linear
ggucaguuuucucu

SEQ ID NO: 1797 - DNA, 14 bp; single-stranded, linear
uugcagucgucagc

SEQ ID NO: 1798 - DNA, 14 bp; single-stranded, linear
cgucagccugaaca

SEQ ID NO: 1799 - DNA, 14 bp; single-stranded, linear
aaacuguuugggac

SEQ ID NO: 1800 - DNA, 14 bp; single-stranded, linear
aaacagcugcaagg

SEQ ID NO: 1801 - DNA, 14 bp; single-stranded, linear
gggcugcuggggcc

SEQ ID NO: 1802 - DNA, 14 bp; single-stranded, linear
ugucagccgaggca

SEQ ID NO: 1803 - DNA, 14 bp; single-stranded, linear
ugccugccucaggc

SEQ ID NO: 1804 - DNA, 14 bp; single-stranded, linear
ugacggcccccacu

SEQ ID NO: 1805 - DNA, 14 bp; single-stranded, linear
gaccugcccggcag

SEQ ID NO: 1806 - DNA, 14 bp; single-stranded, linear
acgcagacgccggc

SEQ ID NO: 1807 - DNA, 14 bp; single-stranded, linear
cuacggaugcacug

SEQ ID NO: 1808 - DNA, 14 bp; single-stranded, linear
aggcuguccaacga

SEQ ID NO: 1809 - DNA, 14 bp; single-stranded, linear
aucccguccaucgc

SEQ ID NO: 1810 - DNA, 14 bp; single-stranded, linear
uugcugcugguggu

SEQ ID NO: 1811 - DNA, 14 bp; single-stranded, linear
gaucggccucuuca

SEQ ID NO: 1812 - DNA, 14 bp; single-stranded, linear
aggcugcugcagga

SEQ ID NO: 1813 - DNA, 14 bp; single-stranded, linear
uucccgucgcuauc

SEQ ID NO: 1814 - DNA, 14 bp; single-stranded, linear
gugccgccugcugg

SEQ ID NO: 1815 - DNA, 14 bp; single-stranded, linear
cgccugcugggcau

SEQ ID NO: 1816 - DNA, 14 bp; single-stranded, linear
caucugccucaccu

SEQ ID NO: 1817 - DNA, 14 bp; single-stranded, linear
acgcagcucaugcc

SEQ ID NO: 1818 - DNA, 14 bp; single-stranded, linear
cuucggcugccucc

SEQ ID NO: 1819 - DNA, 14 bp; single-stranded, linear
cggcugccuccugg

SEQ ID NO: 1820 - DNA, 14 bp; single-stranded, linear
uaccugcucaacug

SEQ ID NO: 1821 - DNA, 14 bp; single-stranded, linear
gugcagaucgcaaa

SEQ ID NO: 1822 - DNA, 14 bp; single-stranded, linear
ggaccgucgcuugg

SEQ ID NO: 1823 - DNA, 14 bp; single-stranded, linear
ucacagauuuuggg

SEQ ID NO: 1824 - DNA, 14 bp; single-stranded, linear
aaacugcugggugc

SEQ ID NO: 1825 - DNA, 14 bp; single-stranded, linear
ugaccguuugggag

SEQ ID NO: 1826 - DNA, 14 bp; single-stranded, linear
cuacagacuccaac

SEQ ID NO: 1827 - DNA, 14 bp; single-stranded, linear
gcccugauggauga

SEQ ID NO: 1828 - DNA, 14 bp; single-stranded, linear
augccgacgaguac

SEQ ID NO: 1829 - DNA, 14 bp; single-stranded, linear
cagcagccccucca

SEQ ID NO: 1830 - DNA, 14 bp; single-stranded, linear
ucacggacuccccu

SEQ ID NO: 1831 - DNA, 14 bp; single-stranded, linear
aagcugucccauca

SEQ ID NO: 1832 - DNA, 14 bp; single-stranded, linear
agacagcuucuugc

SEQ ID NO: 1833 - DNA, 14 bp; single-stranded, linear
auacagcucagacc

SEQ ID NO: 1834 - DNA, 14 bp; single-stranded, linear
gcucagaccccaca

SEQ ID NO: 1835 - DNA, 14 bp; single-stranded, linear
aaccaguccguucc

SEQ ID NO: 1836 - DNA, 14 bp; single-stranded, linear
aguccguucccaaa

SEQ ID NO: 1837 - DNA, 14 bp; single-stranded, linear
ggcccgcuggcucu

SEQ ID NO: 1838 - DNA, 14 bp; single-stranded, linear
auccugucuaucac

SEQ ID NO: 1839 - DNA, 14 bp; single-stranded, linear
aaucagccucugaa

SEQ ID NO: 1840 - DNA, 14 bp; single-stranded, linear
acacuguccagccc

SEQ ID NO: 1841 - DNA, 14 bp; single-stranded, linear
guccagcccaccug

SEQ ID NO: 1842 - DNA, 14 bp; single-stranded, linear
cgacagcccugccc

SEQ ID NO: 1843 - DNA, 14 bp; single-stranded, linear
gcccugcccacugg

SEQ ID NO: 1844 - DNA, 14 bp; single-stranded, linear
acccugacuaccag

SEQ ID NO: 1845 - DNA, 14 bp; single-stranded, linear
ccacagcugaaaau

SEQ ID NO: 1846 - DNA, 14 bp; single-stranded, linear
auccagacucuuuc

SEQ ID NO: 1847 - DNA, 14 bp; single-stranded, linear
ccacagacugguuu

SEQ ID NO: 1848 - DNA, 14 bp; single-stranded, linear
acaccgacuagcca

SEQ ID NO: 1849 - DNA, 14 bp; single-stranded, linear
guucugcuucaagg

SEQ ID NO: 1850 - DNA, 14 bp; single-stranded, linear
ggccggaucgguac

SEQ ID NO: 1851 - DNA, 14 bp; single-stranded, linear
acucugucccuucc

SEQ ID NO: 1852 - DNA, 14 bp; single-stranded, linear
ccacugauggacca

SEQ ID NO: 1853 - DNA, 14 bp; single-stranded, linear
agacugacuuguuu

SEQ ID NO: 1854 - DNA, 14 bp; single-stranded, linear
augccgccccuguc

SEQ ID NO: 1855 - DNA, 14 bp; single-stranded, linear
ccccugucuugcug

SEQ ID NO: 1856 - DNA, 14 bp; single-stranded, linear
acucggauuccagc

SEQ ID NO: 1857 - DNA, 14 bp; single-stranded, linear
uuccagcccacauu

SEQ ID NO: 1858 - DNA, 14 bp; single-stranded, linear
ccacagcugagaau

SEQ ID NO: 1859 - DNA, 14 bp; single-stranded, linear
acaccgcuuuuguu

SEQ ID NO: 1860 - DNA, 14 bp; single-stranded, linear
gcucagaugaaaug

SEQ ID NO: 1861 - DNA, 14 bp; single-stranded, linear
aagcugcucugaaa

SEQ ID NO: 1862 - DNA, 14 bp; single-stranded, linear
ggucagcugccccc

SEQ ID NO: 1863 - DNA, 14 bp; single-stranded, linear
cagcugcccccaaa

SEQ ID NO: 1864 - DNA, 14 bp; single-stranded, linear
ucucugccuugagu

SEQ ID NO: 1865 - DNA, 14 bp; single-stranded, linear
uuacagcucuggcc

SEQ ID NO: 1866 - DNA, 14 bp; single-stranded, linear
uugcagauguuuua

SEQ ID NO: 1867 - DNA, 14 bp; single-stranded, linear
aaccugacugguua

SEQ ID NO: 1868 - DNA, 14 bp; single-stranded, linear
cagcaguccuuugu

SEQ ID NO: 1869 - DNA, 14 bp; single-stranded, linear
uuucagccuacagu

SEQ ID NO: 1870 - DNA, 14 bp; single-stranded, linear
ucccagaucaguca

SEQ ID NO: 1871 - DNA, 11 bp; single-stranded, linear
  The letter "N" stands for any base The letter "H" stands for A, C or U.
nnnnuhnnnnn

SEQ ID NO: 1872 - DNA, 28 bp; single-stranded, linear
  The letter "N" stands for any base.
nnnnncugangagnnnnnncgaaannnn

SEQ ID NO: 1873 - DNA, 15 bp; single-stranded, linear
  The letter "N" stands for any base. The letter "Y" stands for C or U. The letter "H" stands for A, C or U.
nnnnnnnynghynnn

SEQ ID NO: 1874 - DNA, 47 bp; single-stranded, linear
  The letter "N" stands for any base. The letter "H" stands for A, C or U.
nnnngaagnnnnnnnnnnnaaahannnnnnnacauuacnnnnnnnnn

SEQ ID NO: 1875 - DNA, 49 bp; single-stranded, linear
  The letter "N" stands for any base.
cuccaccuccucgcggunnnnnnngggcuacuucgguaggcuaagggag

SEQ ID NO: 1876 - DNA, 176 bp; single-stranded, linear
gggaaagcuugcgaagggcgucgucgccccgagcgguaguaagcagggaacucaccuccaauuucaguacugaaauugucguagcaguugacuacuguuaugugauugguagaggcuaagugacgguauuggcguaagucaguauugcagcacagcacaagcccgcuugcgagaau

SEQ ID NO: 1877 - DNA, 37 bp; single-stranded, linear
  The letter "N" stands for any base. The letter "H" stands for A, C or U.
nnnnnnncugaugaggccgaaaggccgaaannnnnnh

What is claimed is:

1. An enzymatic nucleic acid molecule which specifically cleaves RNA of epidermal growth factor receptor (EGFR) gene, wherein said enzymatic nucleic acid molecule comprises a chemical modification, a substrate binding sequence and a nucleotide sequence within or surrounding said substrate binding sequence wherein said nucleotide sequence imparts to said enzymatic nucleic acid molecule activity for the cleavage of said RNA of the EGFR gene.

2. The enzymatic nucleic acid molecule of claim 1, wherein said substrate binding sequence is complementary to said RNA of the EGFR gene.

3. The enzymatic nucleic acid molecule of claim 1, wherein said enzymatic nucleic acid molecule is a ribozyme.

4. The enzymatic nucleic acid molecule of claim 3, wherein said ribozyme is in a hammerhead motif.

5. The enzymatic nucleic acid molecule of claim 3, wherein said enzymatic nucleic acid molecule is in a hairpin motif.

6. The enzymatic nucleic acid molecule of claim 1, wherein said chemical modification is a sugar modification.

7. The enzymatic nucleic acid molecule of claim 1, wherein said chemical modification is a nucleotide base modification.

8. The enzymatic nucleic acid molecule of claim 1, wherein said chemical modification is a phosphate backbone modification.

9. An enzymatic nucleic acid molecule, which specifically cleaves RNA of epidermal growth factor receptor (EGFR) gene, wherein said enzymatic nucleic acid molecule is a DNAzyme comprising a substrate binding sequence.

10. The enzymatic nucleic acid molecule of claim 1 or 9, wherein said substrate binding sequence comprises between 12 and 100 nucleotides complementary to said RNA of the EGFR gene.

11. The enzymatic nucleic acid molecule of claim 10, wherein said substrate binding sequence comprises between 14 and 24 nucleotides complementary to said RNA of the EGFR gene.

12. The enzymatic nucleic acid molecule of claim 1 or 9, wherein said enzymatic nucleic acid molecule is chemically synthesized.

13. The enzymatic nucleic molecule of claim 1 or 9, wherein said enzymatic nucleic acid molecule is active in the presence of divalent metal ions.

14. The enzymatic nucleic molecule of claim 13, wherein said divalent metal ion is magnesium.

15. A mammalian cell including an enzymatic nucleic acid molecule of claim 1 or 9, wherein said mammalian cell is not a living human.

16. The mammalian cell of claim 15, wherein said mammalian cell is a human cell.

17. The enzymatic nucleic acid molecule of claim 1 or 9, wherein said enzymatic nucleic acid molecule comprises: (a) at least three of the 5' terminal nucleotides having phosphorothioate linkages; (b) at least ten 2'-O-alkyl modifications; and (c) a 3'-end modification.

18. The enzymatic nucleic acid of claim 17, wherein said 3'-end modification is a 3'-3' linked inverted abasic moiety.

19. The enzymatic nucleic acid of claim 17, wherein said 2'-O-alkyl modification is 2'-O-methyl.

20. A method of cleaving the RNA of EGFR gene comprising the step of contacting said RNA with the enzymatic nucleic acid molecule of claim 1 or 9 under conditions suitable for the cleavage of said RNA by the enzymatic nucleic acid molecule.

* * * * *